United States Patent
Ganta et al.

(10) Patent No.: US 11,541,108 B2
(45) Date of Patent: Jan. 3, 2023

(54) TARGETED GENE DISRUPTION METHODS AND IMMUNOGENIC COMPOSITIONS

(71) Applicant: Kansas State University Research Foundation, Manhattan, KS (US)

(72) Inventors: Roman R. Ganta, Manhattan, KS (US); Ying Wang, Manhattan, KS (US)

(73) Assignee: Kansas State University Research Foundation, Manhattan, KS (US)

( * ) Notice: Subject to any disclaimer, the term of this patent is extended or adjusted under 35 U.S.C. 154(b) by 157 days.

(21) Appl. No.: 16/609,097

(22) PCT Filed: Apr. 30, 2018

(86) PCT No.: PCT/US2018/030302
§ 371 (c)(1),
(2) Date: Oct. 28, 2019

(87) PCT Pub. No.: WO2018/201153
PCT Pub. Date: Nov. 1, 2018

(65) Prior Publication Data
US 2020/0188498 A1    Jun. 18, 2020

Related U.S. Application Data

(60) Provisional application No. 62/491,896, filed on Apr. 28, 2017.

(51) Int. Cl.
*A01N 63/00* (2020.01)
*A61K 39/02* (2006.01)
*A61K 39/118* (2006.01)
*C12N 1/20* (2006.01)
*A61K 39/00* (2006.01)

(52) U.S. Cl.
CPC ........ *A61K 39/0233* (2013.01); *A61K 39/118* (2013.01); *C12N 1/20* (2013.01); *A61K 2039/522* (2013.01); *A61K 2039/552* (2013.01)

(58) Field of Classification Search
CPC .............................................. A61K 39/0233
See application file for complete search history.

(56) References Cited

U.S. PATENT DOCUMENTS

2003/0092087 A1* 5/2003 Walker ................... C07K 14/29
435/7.32
2016/0015798 A1 1/2016 Caldwell

FOREIGN PATENT DOCUMENTS

WO    2016118512 A1    7/2016

OTHER PUBLICATIONS

Wang, et al., A genetic system for targeted mutations to disrupt and restore genes in the obligate bacterium, Ehrlichia chaffeensis, Sci Rep, Nov. 17, 2017, vol. 7, pp. 1-13.
Arathy D. S. Nair et al.: Attenuated Mutants of Ehrlichia chaffeensis Induce Protection against Wild-Type Infection Challenge n the Reservoir Host and in an Incidental Host:, Infection and Immunity, vol. 83, No. 7., Jul. 1, 2015, pp. 2827-2835, XP055752661, ISSN: 00199567, DOI: 10.1128/1AI.00487-15.
Chuanmin Cheng et al.: "Targeted and Random Mutagenesis of Ehrilichia chaffeensis for the Indentification of Genes Required for In vivo Infection", Plos Pathogens, vol. 9. No. 2, Feb. 14, 2013, p. e1003171, XP055752668, DOI: 10.137/journal.ppat.1003171.
Konrad E. Mueller et al.: "Gene Deletion by Fluorescence-Reported Allelic Exchange Mutagenesis in Chlamydia trachomatis", MBIO, vol. 7. mp/ 1, Mar. 2, 2016, p. e01817-1,XP055752514, DOI: 10.1128/mBio.01817-15.
Extended European Search Report dated Nov. 23, 2020 in EP18789954 filed Nov. 26, 2019.

\* cited by examiner

*Primary Examiner* — Albert M Navarro
(74) *Attorney, Agent, or Firm* — Tracey S. Truitt; Armstrong Teasdale LLP

(57) ABSTRACT

Targeted disruption of a specific gene and its subsequent restoration in obligate intracellular bacteria remains extremely challenging due to their absolute requirement for residence inside a host cell to replicate. Here, targeted allelic exchange mutations were created to inactivate two genes and then to restore one of the two genes of a rickettsial pathogen, *Ehrlichia chaffeensis*. These methods were then also successfully utilized in *Ehrlichia canis* and *Anaplasma phagocyophilum*. The resultant mutated pathogens are useful in immunogenic compositions for reducing the incidence of or severity of infection with ricksettsial pathogens.

23 Claims, 17 Drawing Sheets
Specification includes a Sequence Listing.

TARGETED GENE DISRUPTION METHODS AND IMMUNOGENIC COMPOSITIONS

The invention was made with government support under grant No. AI070908, awarded by the NIH. The government has certain rights in the invention.

BACKGROUND OF THE INVENTION

Disrupting specific gene function and subsequent restoration of its activity in obligate intracellular bacteria remains extremely challenging due to their absolute requirement for residence inside a host cell to replicate. Here, we created targeted mutations by allelic exchange in two genes and genetically complemented one gene of the rickettsial pathogen *Ehrlichia chaffeensis*. In principle, this approach can be applied to other obligate intracellular bacteria and will enable structure-function analyses routinely done in intracellular bacteria. The method is also applicable in generating attenuated strains of obligate intracellular bacteria, which will be valuable in serving as live vaccine candidates.

Obligate intracellular bacteria (hereafter "obligates") are responsible for causing diseases in millions of people worldwide. They include many pathogenic Gram-negatives of the orders Rickettsiales and Chlamydiales. Lack of an efficient system for targeted mutagenesis in Rickettsiales and Chlamydiales of the genera *Ehrlichia, Anaplasma, Rickettsia, Neorickettssia, Orientia* and *Chlamydia* remains a major impediment in understanding microbial pathogenesis and in defining the functional significance of many bacterial genes. Chlamydiales and Rickettsiales have undergone extreme genome reductions where the majority of genes for each pathogen may be critical for their intracellular growth. Thus, obligate intracellular bacteria depend on their hosts to fill in the deficiencies resulting from genome reductions. Consistent with this hypothesis, prior studies demonstrate that nearly 74-92% of the predicted genes in *Ehrlichia, Anaplasma, Rickettsia, Neorickettsia*, and *Chlamydia* species are transcriptionally active during bacterial replication in the host cells of vertebrates and vectors. Challenges in creating targeted mutations may be attributed to the essential nature of a gene selected for mutagenesis, intracellular replication dependence and the lack of methods to support extracellular growth. Despite the success in generating random mutations using transposon mutagenesis, generating targeted mutations in specific genes of interest followed by complementation is problematic and is also a highly sought-after goal for obligates.

BRIEF SUMMARY OF THE INVENTION

The present disclosure fills this major gap by providing methods to generate at least one stable targeted mutation by allelic exchange in Rickettsiales and Chlamydiales. Advantageously, the disclosure further provides the ability to disrupt or inactivate multiple genes and thereafter restore at least one intact gene by another allelic exchange mutation, resulting in the restored transcription from the inactivated gene from its own promoter. In preferred forms, the disrupted or inactivated genes prevent or at least decrease the ability of the bacteria to replicate in its obligate host while still inducing an immune response specific for the bacteria. Thus, the present disclosure provides attenuated forms of the bacteria that will be useful in immunogenic compositions that induce immune responses that decrease the incidence or severity of at least one clinical sign associated with or caused by Rickettsiales and Chlamydiales when administered prophylactically, and decrease the duration or severity of at least one clinical sign associated with or caused by Rickettsiales and Chlamydiales when administered after infection has already occurred.

"Sequence Identity" as it is known in the art refers to a relationship between two or more polypeptide (poly amino acid) sequences or two or more polynucleotide sequences, namely a reference sequence and a given sequence to be compared with the reference sequence. Sequence identity is determined by comparing the given sequence to the reference sequence after the sequences have been optimally aligned to produce the highest degree of sequence similarity, as determined by the match between strings of such sequences. Upon such alignment, sequence identity is ascertained on a position-by-position basis, e.g., the sequences are "identical" at a particular position if at that position, the nucleotides or amino acid residues are identical. The total number of such position identities is then divided by the total number of nucleotides or amino acid residues in the reference sequence to give % sequence identity. Sequence identity can be readily calculated by known methods, including but not limited to, those described in Computational Molecular Biology, Lesk, A. N., ed., Oxford University Press, New York (1988), Biocomputing: Informatics and Genome Projects, Smith, D. W., ed., Academic Press, New York (1993); Computer Analysis of Sequence Data, Part I, Griffin, A. M., and Griffin, H. G., eds., Humana Press, New Jersey (1994); Sequence Analysis in Molecular Biology, von Heinge, G., Academic Press (1987); Sequence Analysis Primer, Gribskov, M. and Devereux, J., eds., M. Stockton Press, New York (1991); and Carillo, H., and Lipman, D., SIAM J. Applied Math., 48: 1073 (1988), the teachings of which are incorporated herein by reference. Preferred methods to determine the sequence identity are designed to give the largest match between the sequences tested. Methods to determine sequence identity are codified in publicly available computer programs, which determine sequence identity between given sequences. Examples of such programs include, but are not limited to, the GCG program package (Devereux, J., et al., Nucleic Acids Research, 12(1):387 (1984)), BLASTP, BLASTN and FASTA (Altschul, S. F. et al., J. Molec. Biol., 215:403-410 (1990). The BLASTX program is publicly available from NCBI and other sources (BLAST Manual, Altschul, S. et al., NCVI NLM NIH Bethesda, Md. 20894, Altschul, S. F. et al., J. Molec. Biol., 215:403-410 (1990), the teachings of which are incorporated herein by reference). These programs optimally align sequences using default gap weights in order to produce the highest level of sequence identity between the given and reference sequences. As an illustration, by a polynucleotide having a nucleotide sequence having at least, for example, 85%, preferably 90%, even more preferably 95% "sequence identity" to a reference nucleotide sequence, it is intended that the nucleotide sequence of the given polynucleotide is identical to the reference sequence except that the given polynucleotide sequence may include up to 15, preferably up to 10, even more preferably up to 5 point mutations per each 100 nucleotides of the reference nucleotide sequence. In other words, in a polynucleotide having a nucleotide sequence having at least 85%, preferably 90%, even more preferably 95% identity relative to the reference nucleotide sequence, up to 15%, preferably 10%, even more preferably 5% of the nucleotides in the reference sequence may be deleted or substituted with another nucleotide, or a number of nucleotides up to 15%, preferably 10%, even more preferably 5% of the total nucleotides in the reference sequence may be inserted into the reference sequence. These mutations of the reference sequence may occur at the 5' or 3' terminal positions of the reference nucleotide sequence or anywhere between those terminal positions, interspersed either individually among nucleotides in the reference sequence or in one or more contiguous groups within the reference sequence. Analogously, by a polypeptide having a given amino acid sequence having at least, for example, 85%, preferably 90%, even more preferably 95% sequence identity to a reference amino acid sequence, it is intended that the given amino acid sequence of the polypeptide is identical to the reference sequence except that the given polypeptide sequence may include up to 15, preferably up to 10, even more preferably up to 5 amino acid alterations per each 100 amino acids of the reference amino acid sequence. In other words, to obtain a given polypeptide sequence having at least 85%, preferably 90%, even more preferably 95% sequence identity with a reference amino acid sequence, up to 15%, preferably up to 10%, even more preferably up to 5% of the amino acid residues in the reference sequence may be deleted or substituted with another amino acid, or a number of amino acids up to 15%, preferably up to 10%, even more preferably up to 5% of the total number of amino acid residues in the reference sequence may be inserted into the reference sequence. These alterations of the reference sequence may occur at the amino or the carboxy terminal positions of the reference amino acid sequence or anywhere between those terminal positions, interspersed either individually among residues in the reference sequence or in the one or more contiguous groups within the reference sequence. Preferably, residue positions which are not identical differ by conservative amino acid substitutions. However, conservative substitutions are not included as a match when determining sequence identity.

"Sequence homology", as used herein, refers to a method of determining the relatedness of two sequences. To determine sequence homology, two or more sequences are optimally aligned, and gaps are introduced if necessary. However, in contrast to "sequence identity", conservative amino acid substitutions are counted as a match when determining sequence homology. In other words, to obtain a polypeptide or polynucleotide having 95% sequence homology with a reference sequence, 85%, preferably 90%, even more preferably 95% of the amino acid residues or nucleotides in the reference sequence must match or comprise a conservative substitution with another amino acid or nucleotide, or a number of amino acids or nucleotides up to 15%, preferably up to 10%, even more preferably up to 5% of the total amino acid residues or nucleotides, not including conservative substitutions, in the reference sequence may be inserted into the reference sequence. Preferably the homolog sequence comprises at least a stretch of 50, even more preferably at least 100, even more preferably at least 250, and even more preferably at least 500 nucleotides.

A "conservative substitution" refers to the substitution of an amino acid residue or nucleotide with another amino acid residue or nucleotide having similar characteristics or properties including size, hydrophobicity, etc., such that the overall functionality does not change significantly.

Those of skill in the art will understand that the immunogenic composition used herein may incorporate known injectable, physiologically acceptable sterile solutions for preparing a ready-to-use solution for parenteral injection or infusion, aqueous isotonic solutions, such as e.g. saline or corresponding plasma protein solutions, are readily available. In addition, the immunogenic and vaccine compositions of the present disclosure can include diluents, isotonic agents, stabilizers, or adjuvants. Diluents can include water, saline, dextrose, ethanol, glycerol, and the like. Isotonic agents can include sodium chloride, dextrose, mannitol, sorbitol, and lactose, among others. Stabilizers include albumin and alkali salts of ethylendiamintetracetic acid, among others.

In one aspect, the immunogenic composition may also comprise additional elements, antigens, pharmaceutical-acceptable carriers, veterinary-acceptable carriers, adjuvants, preservatives, stabilizers, or combinations thereof.

"Adjuvants" as used herein, can include aluminum hydroxide and aluminum phosphate, saponins, Quil A, cyclic GMP-AMP, montanide gel, QS-21 (Cambridge Biotech Inc., Cambridge Mass.), GPI-0100 (Galenica Pharmaceuticals, Inc., Birmingham, Ala.), water-in-oil emulsion, oil-in-water emulsion, water-in-oil-in-water emulsion. The emulsion can be based in particular on light liquid paraffin oil (European Pharmacopea type); isoprenoid oil such as squalane or squalene oil resulting from theoligomerization of alkenes, in particular of isobutene or decene; esters of acids or of alcohols containing a linear alkyl group, more particularly plant oils, ethyl oleate, propylene glycol di-(caprylate/caprate), glyceryl tri-(caprylate/caprate) or propylene glycol dioleate; esters of branched fatty acids or alcohols, in particular isostearic acid esters. The oil is used in combination with emulsifiers to form the emulsion. The emulsifiers are preferably nonionic surfactants, in particular esters of sorbitan, of mannide (e.g. anhydromannitol oleate), of glycol, of polyglycerol, of propylene glycol and of oleic, isostearic, ricinoleic or hydroxystearic acid, which are optionally ethoxylated, and polyoxypropylene-polyoxyethylene copolymer blocks, in particular the Pluronic products, especially L121. See Hunter et al., The Theory and Practical Application of Adjuvants (Ed. Stewart-Tull, D. E. S.). JohnWiley and Sons, NY, pp 51-94 (1995) and Todd et al., Vaccine 15:564-570 (1997). For example, it is possible to use the SPT emulsion described on page 147 of "Vaccine Design, The Subunit and Adjuvant Approach" edited by M. Powell and M. Newman, Plenum Press, 1995, and the emulsion MF59 described on page 183 of this same book. A further instance of an adjuvant is a compound chosen from the polymers of acrylic or methacrylic acid and the copolymers of maleic anhydride and alkenyl derivative. Advantageous adjuvant compounds are the polymers of acrylic or methacrylic acid which are cross-linked, especially with polyalkenyl ethers of sugars or polyalcohols. These compounds are known by the term carbomer (Phameuropa Vol. 8, No. 2, June 1996). Persons skilled in the art can also refer to U.S. Pat. No. 2,909,462 which describes such acrylic polymers cross-linked with a polyhydroxylated compound having at least 3 hydroxyl groups, preferably not more than 8, the hydrogen atoms of at least three hydroxyls being replaced by unsaturated aliphatic radicals having at least 2 carbon atoms. The preferred radicals are those containing from 2 to 4 carbon atoms, e.g. vinyls, allyls and other ethylenically unsaturated groups. The unsaturated radicals may themselves contain other substituents, such as methyl. Further suitable adjuvants include, but are not limited to, the RIBI adjuvant system (Ribi Inc.), Block co-polymer (CytRx, Atlanta Ga.), SAF-M (Chiron, Emeryville Calif.), monophosphoryl lipid A, Avridine lipid-amine adjuvant, heat-labile enterotoxin from *E. coli* (recombinant or otherwise), cholera toxin, IMS 1314, or muramyl dipeptide among many others.

Preferably, the adjuvant is added in an amount of about 100 μg to about 10 mg per dose. Even more preferably, the adjuvant is added in an amount of about 100 μg to about 10 mg per dose. Even more preferably, the adjuvant is added in an amount of about 500 µg to about 5 mg per dose. Even more preferably, the adjuvant is added in an amount of about 750 µg to about 2.5 mg per dose. Most preferably, the adjuvant is added in an amount of about 1 mg per dose.

Additionally, the composition can include one or more pharmaceutical-acceptable or veterinary-acceptable carriers. As used herein, "a pharmaceutical-acceptable carrier" or "a veterinary-acceptable carrier" includes any and all solvents, dispersion media, coatings, stabilizing agents, diluents, preservatives, antibacterial and antifungal agents, isotonic agents, adsorption delaying agents, and the like.

Pharmaceutically acceptable vehicle is understood as designating a compound or a combination of compounds entering into a pharmaceutical composition or vaccine which does not provoke secondary reactions and which allows, for example, the facilitation of the administration of the active compound, an increase in its duration of life and/or its efficacy in the body, an increase in its solubility in solution or alternatively an improvement in its conservation. These pharmaceutically acceptable vehicles are well known and will be adapted by the person skilled in the art as a function of the nature and of the mode of administration of the chosen active compound.

For example, the immunogenic composition or vaccine according to the present disclosure may be administered one time or several times, spread out over time in an amount of about 0.1 to 1000 µg per kilogram weight of the animal or human, where values and ranges such as, but not limited to, 0.5 to 800 µg per kilogram weight of the animal or human, 1 to 1000 µg per kilogram weight of the animal or human, 1 to 500 µg per kilogram weight of the animal or human, 1 to 300 µg per kilogram weight of the animal or human, 1 to 200 µg per kilogram weight of the animal or human, 1 to 150 µg per kilogram weight of the animal or human, 1 to 125 µg per kilogram weight of the animal or human, 1 to 100 µg per kilogram weight of the animal or human, 5 µg per kilogram weight of the animal or human, 10 µg per kilogram weight of the animal or human, 15 µg per kilogram weight of the animal or human, 20 µg per kilogram weight of the animal or human, 25 µg per kilogram weight of the animal or human, 30 µg per kilogram weight of the animal or human, 35 µg per kilogram weight of the animal or human, 40 µg per kilogram weight of the animal or human, 45 µg per kilogram weight of the animal or human, 50 µg per kilogram weight of the animal or human, 55 µg per kilogram weight of the animal or human, 60 µg per kilogram weight of the animal or human, 65 µg per kilogram weight of the animal or human, 70 µg per kilogram weight of the animal or human, 75 µg per kilogram weight of the animal or human, 80 µg per kilogram weight of the animal or human, 85 µg per kilogram weight of the animal or human, 90 µg per kilogram weight of the animal or human, 95 µg per kilogram weight of the animal or human, 100 µg per kilogram weight of the animal or human, 125 µg per kilogram weight of the animal or human, 150 µg per kilogram weight of the animal or human, 200 µg per kilogram weight of the animal or human, 250 µg per kilogram weight of the animal or human, 300 µg per kilogram weight of the animal or human, 400 µg per kilogram weight of the animal or human, 500 µg per kilogram weight of the animal or human, 600 µg per kilogram weight of the animal or human, 700 µg per kilogram weight of the animal or human, 800 µg per kilogram weight of the animal or human, 900 µg per kilogram weight of the animal or human, and 1000 µg per kilogram weight of the animal or human are envisioned. In other preferred forms, the above amounts are also provided without reference to the weight of the animal or human.

According to the present disclosure, the immunogenic composition or vaccine may include at least one further pathogen other than *E. chaffeensis*, making it a combination vaccine or immunogenic composition. In such an embodiment, an effective amount of a vaccine or immunogenic composition administered provides effective protection including a reduction in the severity or incidence of clinical signs of infection up to and including immunity against infections caused by Rickettsiale or Chlamydiale bacteria and at least one further disease-causing organism. The further pathogen is preferably selected from the group consisting of: *Actinobacillus pleuropneumonia*; Adenovirus; Alphavirus such as Eastern equine encephalomyelitis viruses; *Bordetella bronchiseptica; Brachyspira* spp., preferably *B. hyodyentheriae; B. piosicoli, Brucella suis*, preferably biovars 1, 2, and 3; Classical swine fever virus; *Clostridium* spp., preferably *Cl. difficile, Cl. perfringens* types A, B, and C, *Cl. novyi, Cl. septicum, Cl. tetani*; Coronavirus, preferably Porcine Respiratory Corona virus; *Eperythrozoonosis suis; Erysipelothrix rhusiopathiae; Escherichia coli; Haemophilus parasuis*, preferably subtypes 1, 7 and 14: Hemagglutinating encephalomyelitis virus; Japanese Encephalitis Virus; *Lawsonia intracellularis; Leptospira* spp.; preferably *Leptospira australis; Leptospira canicola; Leptospira grippotyphosa; Leptospira icterohaemorrhagicae*; and *Leptospira interrogans; Leptospira pomona; Leptospira tarassovi; Mycobacterium* spp. preferably *M. avium; M. intracellulare*; and *M. bovis; Mycoplasma hyopneumoniae* (*M. hyo*); *Pasteurella multocida*; Porcine cytomegalovirus; Porcine Parvovirus; Porcine Reproductive and Respiratory Syndrome (PRRS) Virus; Porcine circovirus, Pseudorabies virus; Rotavirus; *Salmonella* spp.; preferably *S. thyhimurium*; and *S. choleraesuis; Staph. hyicus; Staphylococcus* spp., *Streptococcus* spp., preferably *Strep. suis*; Swine herpes virus; Swine Influenza Virus; Swine pox virus; Swine pox virus; Vesicular stomatitis virus; Virus of vesicular exanthema of swine; *Leptospira Hardjo; Mycoplasma hyosynoviae*; Poliovirus; Rhinovirus; hepatitis A virus; foot-and-mouth disease virus (FMDV); swine vesicular disease (SVDV), and combinations thereof.

The immunogenic compositions can further include one or more other immunomodulatory agents such as, e. g., interleukins, interferons, or other cytokines.

The immunogenic compositions can also include Gentamicin and Merthiolate.

While the amounts and concentrations of adjuvants and additives useful in the context of the present invention can readily be determined by the skilled artisan, the present invention contemplates compositions comprising from about 50 μg to about 2000 μg of adjuvant. Thus, the immunogenic composition as used herein also refers to a composition that comprises from about 1 ug/ml to about 60 μg/ml of antibiotics or immunomodulatory agents, and more preferably less than about 30 μg/ml of antibiotics or immunomodulatory agents.

According to a further aspect, at least one further administration of at least one dose of the immunogenic composition as described above is given to a subject in need thereof, wherein the second or any further administration is given at least 7 days beyond the initial or any former administrations. Preferably, the immunogenic composition is administered with an immune stimulant. Preferably, said immune stimulant is given at least twice. Preferably, at least 3 days, more preferably at least 5 days, even more preferably at least 7 days are in between the first and the second or any further administration of the immune stimulant. Preferably, the immune stimulant is given at least 10 days, preferably 15 days, even more preferably 20, even more preferably at least 22 days beyond the initial administration of the immunogenic composition provided herein. A preferred immune stimulant is, for example, keyhole limpet hemocyanin (KLH), preferably emulsified with incomplete Freund's adjuvant (KLH/ICFA). However, it is herewith understood, that any other immune stimulant known to a person skilled in the art can also be used. The term "immune stimulant" as used herein, means any agent or composition that can trigger the immune response, preferably without initiating or increasing a specific immune response, for example the immune response against a specific pathogen. It is further instructed to administer the immune stimulant in a suitable dose.

In further aspect, the present disclosure provides methods for generating at least one stable targeted mutation by allelic exchange for the genera *Ehrlichia, Anaplasma, Neorickettsia, Rickettsia, Orientia* and *Chlamydia*.

In a still further aspect of the present disclosure, Rickettsiales and Chlamydiales mutated using the disclosed methods are useful in immunogenic compositions against Rickettsiale and Chlamydiale pathogens. In preferred forms, such immunogenic compositions are effective at reducing the incidence or severity of at least one clinical sign of infection caused by or associated with infection by Rickettsiale and Chlamydiale pathogens. In some preferred forms, such compositions are administered prophylactically such that clinical signs are reduced in incidence and/or severity. In particularly preferred forms, the clinical signs are prevented in animals receiving such compositions prior to being infected or challenged with Rickettsiale and/or Chlamydiale pathogens. In other forms, such compositions are administered after infection by Rickettsiale and/or Chlamydiale pathogens has already occurred. In such situations, the clinical signs associated with or caused by the infections are reduced in incidence, severity, and/or longevity.

In a further aspect, the stable targeted mutation disrupts the function of at least one gene.

In yet a further aspect, the function of a gene that has been disrupted can be restored.

In one aspect of the present disclosure, stable targeted mutations were made in *E. chaffeensis* where two genes were disrupted and subsequently had function restored from one gene. These same methods were also successfully used in *Ehrlichia* species including *Ehrlichia canis* (*E. canis*) and *Anaplasma* species including *Anaplasma phagocyophilum* (*A. phagocyophilum*).

In another aspect, the present disclosure provides a method of targeted gene disruption or mutation in *Ehrlichia, Anaplasma, Rickettsia, Neorickettsia, Orientia* and/or *Chlamydia* species to generate attenuated organisms of the bacteria, which will be valuable in inducing effective host immune responses to confer protection against the virulent diseases caused by those same species.

In yet a further aspect, a method for eliciting an immune response in a human or animal is provided, where the steps include administration of an immunogenic composition or vaccine disclosed herein to an animal or human in need thereof. Additionally, a method for reducing the incidence and/or severity of at least one or more clinical signs associated with or caused by infection by a pathogen from the genera *Ehrlichia, Anaplasma, Neorickettsia, Rickettsia, Orientia* and/or *Chlamydia* is provided. In some forms, the infection is caused by or associated with *E. chaffeensis, E. canis, A. marginale, A. platys*, and/or *A. phagocyophilum* and the immunogenic composition or vaccine comprises at least one of those species wherein the targeted gene disruption or mutation is performed on such a species. Such a method generally comprises the step of administering the immunogenic composition to an animal in need thereof to elicit an immune response against infection and subsequent exhibition of clinical signs in animals infected or challenged by a species of the genera *Ehrlichia, Anaplasma, Neorickettsia, Rickettsia, Orientia* and *Chlamydia* after administration of the immunogenic composition. In some forms, the immunogenic composition includes a modified live species of *Ehrlichia, Anaplasma, Neorickettsia, Rickettsia, Orientia*, or *Chlamydia.*

In one aspect, the immunogenic composition includes *E. chaffeensis, E. canis, A. phagocyophilum*, or *A. marginale* that has undergone the targeted mutagenesis described herein. When *E. chaffeensis* is the mutated species, the immunogenic composition preferably includes an attenuated *E. chaffeensis* bacteria that includes a mutation that inactivates the bacteria and interferes with its ability to replicate. In some preferred forms, the mutation is an insertion or deletion. In some forms, the insertion or deletion anywhere within a gene selected from the group consisting of Ech_0379 or Ech_0660 gene, resulting in the inactivation of gene function. In some forms, the genome of the *E. chaffeensis* includes a sequence having at least 70%, at least 75%, at least 80%, at least 85%, at least 90%, or at least 95, 96, 97, 98, 99, or even 100% sequence identity to Ech_0660 (SEQ ID No. 35). Preferably the sequence comparison is in comparison to a non-mutated version of the same region of the *E. chaffeensis* genome. When *E. canis* is the mutated species, the immunogenic composition preferably includes an attenuated *E. canis* bacteria that includes a mutation that inactivates the bacterial gene and interferes with its ability to replicate. In some preferred forms, the mutation is an insertion or deletion. In some forms, the insertion or deletion is in the Ecaj_0381 gene anywhere within the gene resulting in the gene function inactivation. In some forms, the genome of the *E. canis* includes a sequence having at least 70%, at least 75%, at least 80%, at least 85%, at least 90%, or at least 95, 96, 97, 98, 99, or even 100% sequence identity to SEQ ID No. 54. Preferably the sequence comparison is in comparison to a non-mutated version of the same region of the *E. canis* genome. When *A. phagocytophilum* is the mutated species, the immunogenic composition preferably includes an attenuated *A. phagocytophilum* bacteria that includes a mutation that inactivates the bacteria and interferes with its ability to replicate. In some preferred forms, the mutation is an insertion or deletion. In some forms, the insertion or deletion is in the APH_0634 gene anywhere within the gene resulting in the gene function inactivation. In some forms, the genome of the *A. phagocytophilum* APH_0634 gene includes a sequence having at least 70%, at least 75%, at least 80%, at least 85%, at least 90%, or at least 95, 96, 97, 98, 99, or even 100% sequence identity to SEQ ID No. 55. Preferably the sequence comparison is in comparison to a non-mutated version of the same region of the *A. phagocytophilum* genome.

The immunogenic composition or vaccine and methods provided in this disclosure are not limited to *E. chaffeensis, E. canis*, or *A. phygocytophilum*, but may also include any member of the orders Rickettsiales or Chlamydiales, including but not limited to the families of Pelagibacterales, Pelagibacteraceae (including subgroups Ib, II, IIIa, IIIb, IV, and V), Pelagibacter, Proro-mitochondira, Anaplasmataceae, species of the genera *Ehrlichia, Anaplasma, Wolbachia, Neorickettsia*; Midichloriaceae, Midichloria, Rickettsiaceae, and *Rickettsia* species. Further, the immunogenic composition or vaccine may also include, but is not limited to, *E. ruminantium, E. canis, A. marginale, A. platys, E. muris* and combinations thereof.

In a further aspect of the present disclosure, the immunogenic composition comprises a homolog of the *E. chaffeensis* ECH_0660 gene that has been mutated using the methods provided herein. In preferred forms, the homolog is selected from the group consisting of the genera *Ehrlichia, Anaplasma, Rickettsia, Neorickettsia, Orientia* and *Chlamydia*. In other preferred forms, the gene homolog is Ecaj_0381 of *E. canis*, preferably having at least 70%, 75%, 80%, 85%, 90%, and more preferably at least 92%, still more preferably at least 94%, even more preferably at least 95, 96, 97, 98, 99, or even 100% sequence homology with GenBank #CP000107.1. In other preferred forms, the gene homolog is Erum_3930 of *E. ruminatium*, preferably having at least 70%, 75%, 80%, 85%, 90%, and more preferably at least 92%, still more preferably at least 94%, even more preferably at least 95, 96, 97, 98, 99, or even 100% sequence homology with GenBank #CR767821.1. In other preferred forms, the gene homolog is APH_0634 of *Anaplasma phagocytophilum*, preferably having at least 70%, 75%, 80%, 85%, 90%, and more preferably at least 92%, still more preferably at least 94%, even more preferably at least 95, 96, 97, 98, 99, or even 100% sequence homology with GenBank #CP000235.1. In other preferred forms, the gene homolog is AMH_581 of *Anaplasma marginale*, preferably having at least 70%, 75%, 80%, 85%, 90%, and more preferably at least 92%, still more preferably at least 94%, even more preferably at least 95, 96, 97, 98, 99, or even 100% sequence homology with GenBank #CP000030.1. In other preferred forms, the gene homolog is EMUR_02070 of *Ehrlichia muris* AS145, preferably having at least 70%, 75%, 80%, 85%, 90%, and more preferably at least 92%, still more preferably at least 94%, even more preferably at least 95, 96, 97, 98, 99, or even 100% sequence homology with GenBank #CP006917.1.

The immunogenic composition according to the disclosure may be administered intravenously, intramuscularly, intranasally, intradermally, intratracheally, intravaginally, intravenously, intravascularly, intraarterially, intraperitoneally, orally, intrathecally, or by direct injection into any target tissue. Depending on the desired duration and effectiveness of the treatment, the immunogenic compositions according to the disclosure may be administered once or several times, also intermittently, for instance on a daily basis for several days, weeks or months and in different dosages.

In another aspect, immunogenic composition of the present disclosure is administered to an animal in need thereof at least two weeks of age. More preferably, the animal is between 2 weeks and 1 year of age, still more preferably between 3 weeks and 6 months of age. Of course, other ages and ranges are contemplated such as 4, 5, 6, 7, 8, 9, 10, 11, 12, 13, 14, 15, 16, 17, 18, 19, and 20 weeks or more. Alternatively, the immunogenic composition is administered at least 2 weeks prior to exposure to a Rickettsiale or Chlamydiale bacteria.

In some forms, the immunogenic composition is administered after infection by the Rickettsiale or Chlamydiale bacteria. In such situations, the administration reduces the duration or severity of clinical signs associated with or caused by the infection.

In another aspect, the present disclosure provides an immunogenic composition comprising a Rickettsiale or Chlamydiale bacteria having a targeted allelic exchange mutation therein and a component selected from the group consisting of a veterinary-acceptable carrier, a pharmaceutical-acceptable carrier, an adjuvant, a preservative, a buffer, an antibiotic, cell culture supernatant, an immunomodulatory agent and any combination thereof. In some forms, the immunogenic composition the Rickettsiale or Chlamydiale bacteria is selected from the group consisting of species of *Ehrlichia, Anaplasma, Neorickettsia, Rickettsia, Orientia* and *Chlamydia*. In some forms, the *Ehrlichia* species bacteria are selected from the group consisting of *Ehrlichia chaffeensis, Ehrlichia canis, Ehrlichia ruminatium, Ehrlichia muris* and *Ehrlichia muris* like agent. In some forms, the *Anaplasma* bacteria species are selected from the group consisting of *Anaplasma phagocytophilum, Anaplasma platys*, and *Anaplasma marginale*. In some forms, the targeted allelic exchange mutation inactivates a gene. In some forms, the inactivation results from an insertion or deletion. In some forms, the inactivation results in a decreased ability of the bacteria to replicate. In some forms, the targeted allelic exchange mutation is in Ech_0230, Ech_0379, or Ech_0660 in *Ehrlichia chaffeensis*. In some forms, the targeted allelic exchange mutation is in Ecaj_0381 in *Ehrlichia canis*. In some forms, the targeted allelic exchange mutation is in APH_0634 in *Anaplasma phagocytophilum*.

In another aspect, the present disclosure provides a method of reducing the incidence of or severity of at least one clinical sign caused by a Rickettsiale or Chlamydiale bacteria comprising the step of administering an immunogenic composition comprising a Rickettsiale or Chlamydiale bacteria having a targeted allelic exchange mutation therein and a component selected from the group consisting of a veterinary-acceptable carrier, a pharmaceutical-acceptable carrier, an adjuvant, a preservative, a buffer, an antibiotic, cell culture supernatant, an immunomodulatory agent. In some forms, the administering step is selected from the group consisting of intramuscularly, intranasally, intradermally, intratracheally, intravaginally, intravenously, intravascularly, intraarterially, intraperitoneally, orally, intrathecally, or by direct injection into target tissues. In some forms, the administration of the immunogenic composition can be termed a first administration and this first administration is followed by a second administration. In some forms, the second administration is at least 7 days after the first administration. In preferred forms, the reduction in incidence is in a group of animals that have received an administration of the immunogenic composition and at least 10% is in comparison to a group of animals that have not received an administration of the immunogenic composition. In preferred forms, the reduction in severity is assessed in a single animal that has received an administration of the immunogenic composition and is in comparison to an animal that has not received the immunogenic composition. In preferred forms, this reduction in severity is at least 10% when comparing an animal that has received the composition with an animal that has not received the immunogenic composition and that has been subsequently infected or challenged by a Rickettsiale or Chlamydiale bacteria. In some forms, the reduction in severity in a group of animals that have received the immunogenic composition is at least 10% in comparison to a group of animals that have not received an administration of the immunogenic composition. In some forms, the Rickettsiale or Chlamydiale bacteria is selected from the group consisting of *Ehrlichia, Anaplasma, Rickettsia, Neorickettsia, Orientia* and *Chlamydia*. In some forms, the *Ehrlichia* bacteria are selected from the group consisting of *Ehrlichia chaffeensis, Ehrlichia ruminatium, Ehrlichia muris*, and *Ehrlichia canis*. In some forms, the *Anaplasma* bacteria are selected from the group consisting of *Anaplasma phagocytophilum*, *Anaplasma platys*, and *Anaplasma marginale*. In some forms, the targeted allelic exchange mutation inactivates a gene. In some forms, the inactivation results from an insertion or deletion. In some forms, the inactivation results in a decreased ability of the bacteria to replicate. In some forms, the targeted allelic exchange mutation is in Ech_0230, Ech_0379, or Ech_0660 in *Ehrlichia chaffeensis*. In some forms, the targeted allelic exchange mutation is in Ecaj_0381 in *Ehrlichia canis*. In some forms, the targeted allelic exchange mutation is in APH_0634 in *Anaplasma phagocytophilum*. In some forms, the component is an adjuvant selected from the group consisting of a saponin, cyclic GMP-AMP, montanide gel, or any combination thereof.

DETAILED DESCRIPTION OF THE INVENTION

Figure 1:
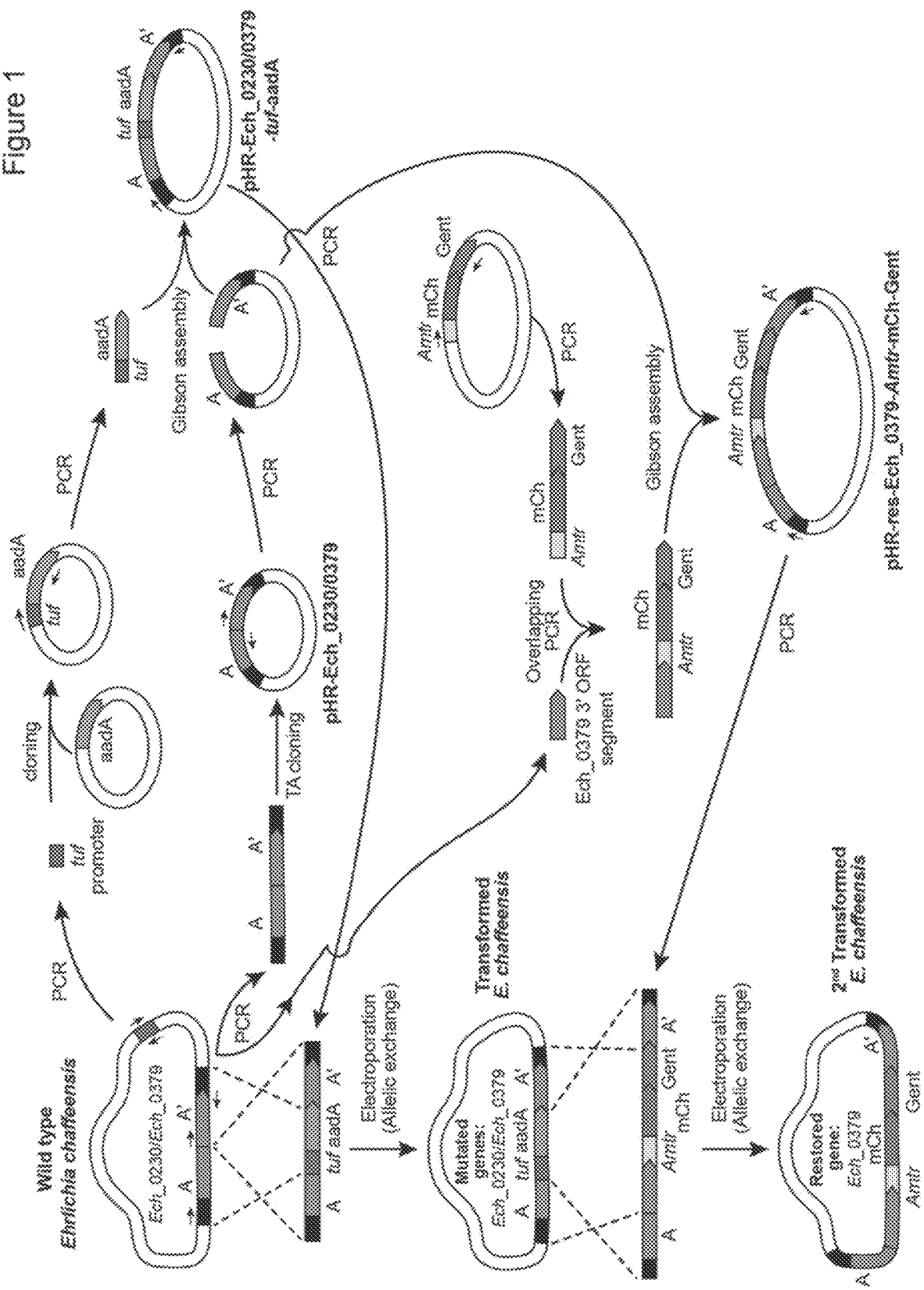
FIG. 1 is an illustration outlining the schematic representation of the strategies employed for creating targeted allelic exchange mutations in *E. chaffeensis* to inactivate genes Ech_0230 and Ech_0379 and to restore the inactivated gene function of Ech_0379, wherein A and A' refer to 5' and 3' homology arms.

The present disclosure provides for a method of providing stable, immunogenic bacteria capable of producing an immunogenic response in a host. The method preferably comprises the steps of a targeted disruption in the genome of the bacterial strain and then performing an allelic exchange.

The present disclosure provides for an immunogenic composition or vaccine that comprises administration of the immunogenic bacteria disclosed herein. The immunogenic bacteria for use in the immunogenic composition or vaccine may be killed, modified killed, modified live, a recombinant protein, a protein, and combinations thereof. In preferred forms, the modified live immunogenic bacteria are attenuated.

A method for preventing or treating at least one of rickettsioses, ehrlichiosis, Rocky Mountain Spotted Fever, human monocyte ehrlichiosis, granulocytic anaplasmosis, and/or anaplasmosis is provided. The steps of the method generally include administration of the immunogenic composition or vaccine disclosed herein to a human or animal in need thereof.

A method for reducing the incidence or severity of clinical symptoms associated with at least one of rickettsioses, ehrlichiosis, Rocky Mountain Spotted Fever, human monocyte ehrlichiosis, granulocytic anaplasmosis, and/or anaplasmosis is provided, where the steps generally include administration of the immunogenic composition or vaccine disclosed herein to a human or animal in need thereof. The clinical symptoms generally include, but are not limited to, fever, headache, chills, malaise, muscle pain, abdominal pain, nausea, vomiting, diarrhea, confusion, conjunctival injection (red eyes), rash, and combinations thereof. Preferably the clinical symptoms associated with at least one of rickettsioses, ehrlichiosis, Rocky Mountain Spotted Fever, human monocyte ehrlichiosis, granulocytic anaplasmosis, and/or anaplasmosis are reduced in frequency and/or severity by at least 10%, at least 20%, at least 30%, at least 40%, at least 50%, at least 60%, at least 70%, at least 80%, at least 90% or reduced by 100%. This is in comparison to an animal or human not receiving the immunogenic composition or vaccine of the present disclosure. Comparisons to groups of animals or humans is also contemplated herein.

The recipient of the product and method of the present disclosure may be a human or an animal. The animal is preferably selected from, but not limited to, porcine, pigs, cattle, goats, horses, dogs, deer, coyote, cats, poultry, and other related wild and domestic animals. In a preferred embodiment, the recipient is a human, a dog, a cow or cattle, a horse, or a pig.

Modified or modified live nucleotide sequence will be understood as meaning any nucleotide sequence obtained by mutagenesis according to techniques well known to the person skilled in the art, and containing modifications with respect to the normal sequences according to the disclosure, for example mutations in the regulatory and/or promoter sequences of polypeptide expression, especially leading to a modification of the rate of expression of said polypeptide or to a modulation of the replicative cycle.

Nucleotide, polynucleotide or nucleic acid sequence will be understood according to the present disclosure as meaning both a double-stranded or single-stranded DNA in the monomeric and dimeric (so-called in tandem) forms and the transcription products of said DNAs.

It must be understood that the present disclosure does not relate to the genomic nucleotide sequences taken in their natural environment, that is to say, in the natural state. It concerns sequences for which it has been possible to isolate, purify or partially purify, starting from separation methods such as, for example, ion-exchange chromatography, by exclusion based on molecular size, or by affinity, or alternatively fractionation techniques based on solubility in different solvents, or starting from methods of genetic engineering such as amplification, cloning and subcloning, it being possible for the sequences of the disclosure to be carried by vectors. Further, the sequences have been altered from what is found in nature to include mutations induced through site-directed mutagenesis or other attenuation techniques, such as serial passaging, further demonstrating that the sequences are made by the hand of man and not found in nature.

The attenuated modified live vaccine or immunogenic composition of the present invention does not contain a nucleotide or amino acid sequence found in nature, as it has been constructed by the hand of man. Therefore, the immunogenic composition or vaccine of the present invention is markedly different from what is found in nature. Similar to Example 5 for the Nature-Based Product Examples of eligible subject matter under 35 U.S.C. 101 issued by the US Patent Office in 2014, the immunogenic composition or vaccine of the present invention is like claim 2 of that example because the immunogenic composition or vaccine gene has additional elements, such as the mutations within the sequence or inactivation of the virus that provides it with a functionally different characteristic than, for example, naturally occurring *E. chaffeensis*.

Figure 5A:
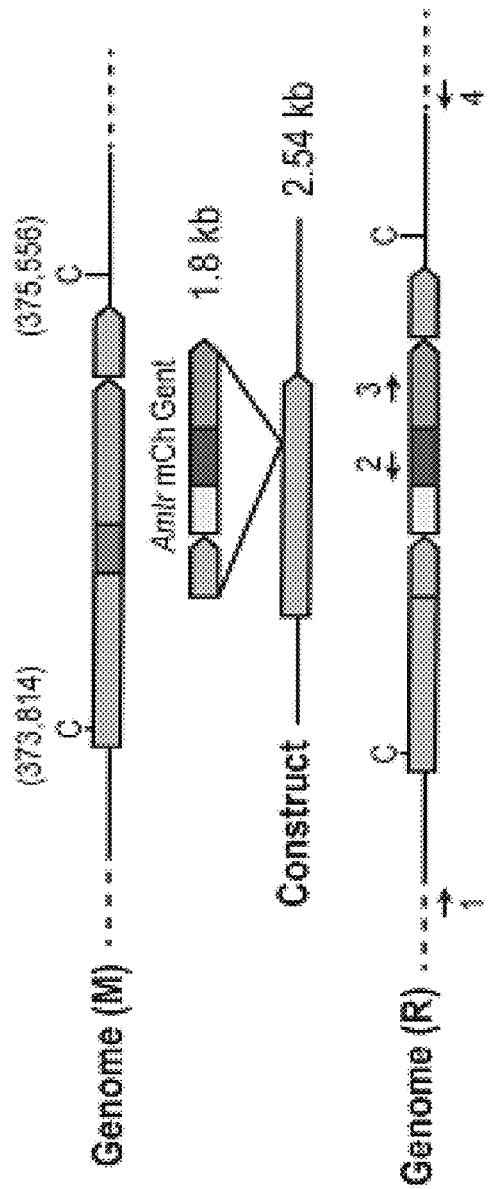
FIG. 5A illustrates targeted allelic exchange mutagenesis to restore the Ech_0379 gene similar to FIG. 3 except that the illustration depicting the genomic segment at the top portion of the panel represents the genome from Ech_0379 mutant.
Figure 5B:
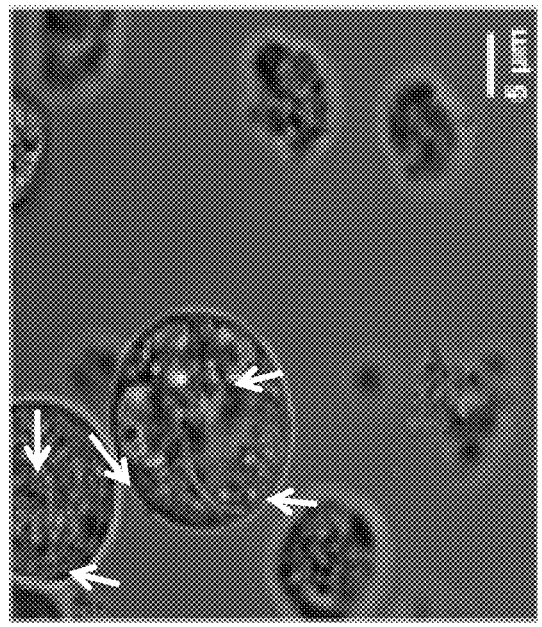
FIG. 5B illustrates the Ech_0379 gene restoration mutant culture expressing mCherry. The restored mutant organisms cultured in ISE6 cells were assessed for the mCherry expression by confocal microscopy using 40× magnification lens wherein the mCherry expression was exhibited at the arrow.
Figure 5C:
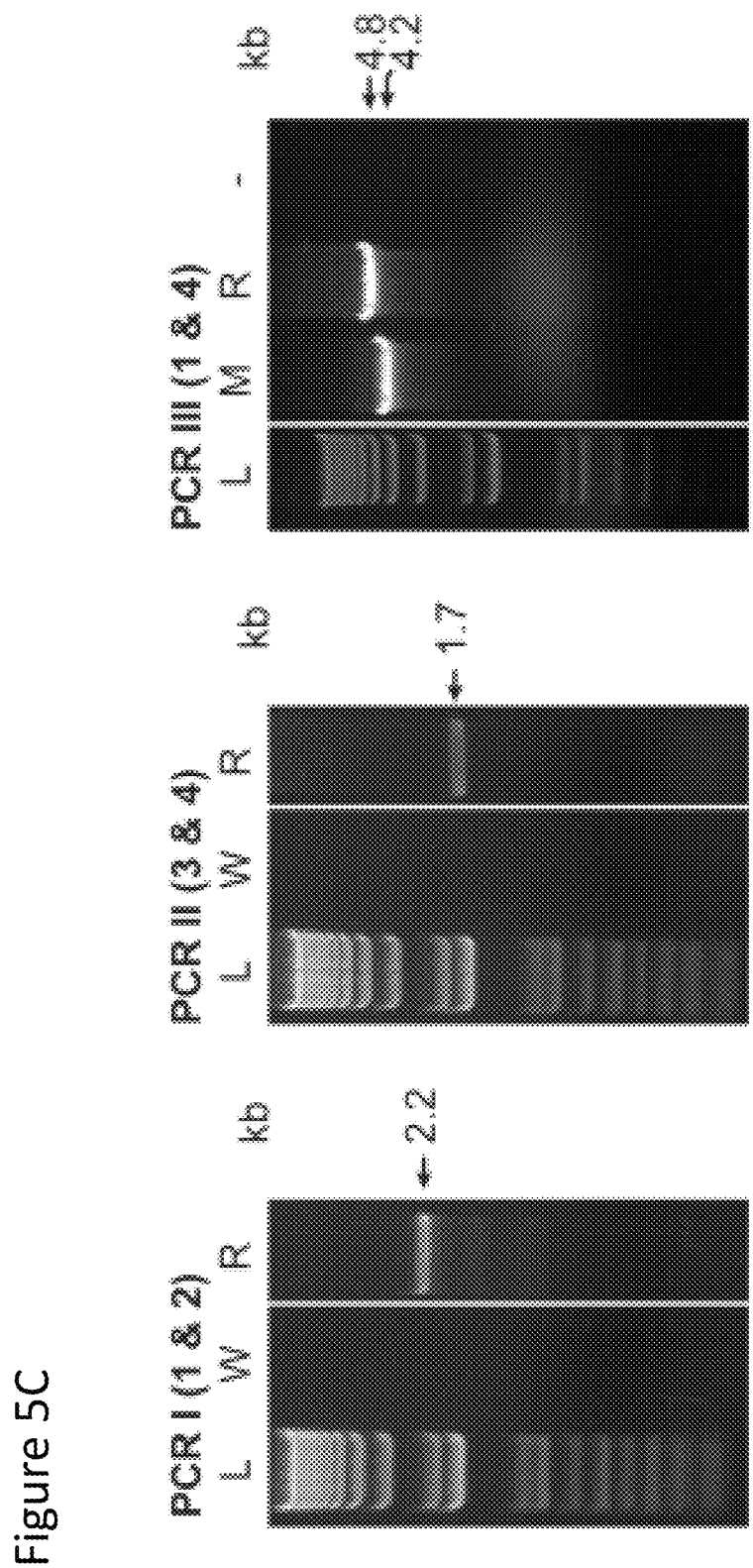
FIG. 5C is a picture showing amplicons resolved following three different PCRs using primers targeting to the genomic regions upstream and downstream to the allelic insertion (primers identified as 1 and 4) and to the inserted DNA (primers; 2 and 3). (L, 1 kb plus molecular weight DNA markers; Wild Type (W), PCR with wild type genomic DNA as the template; Mutant (M), PCR with mutant genomic DNA as the template.
Figure 5D:
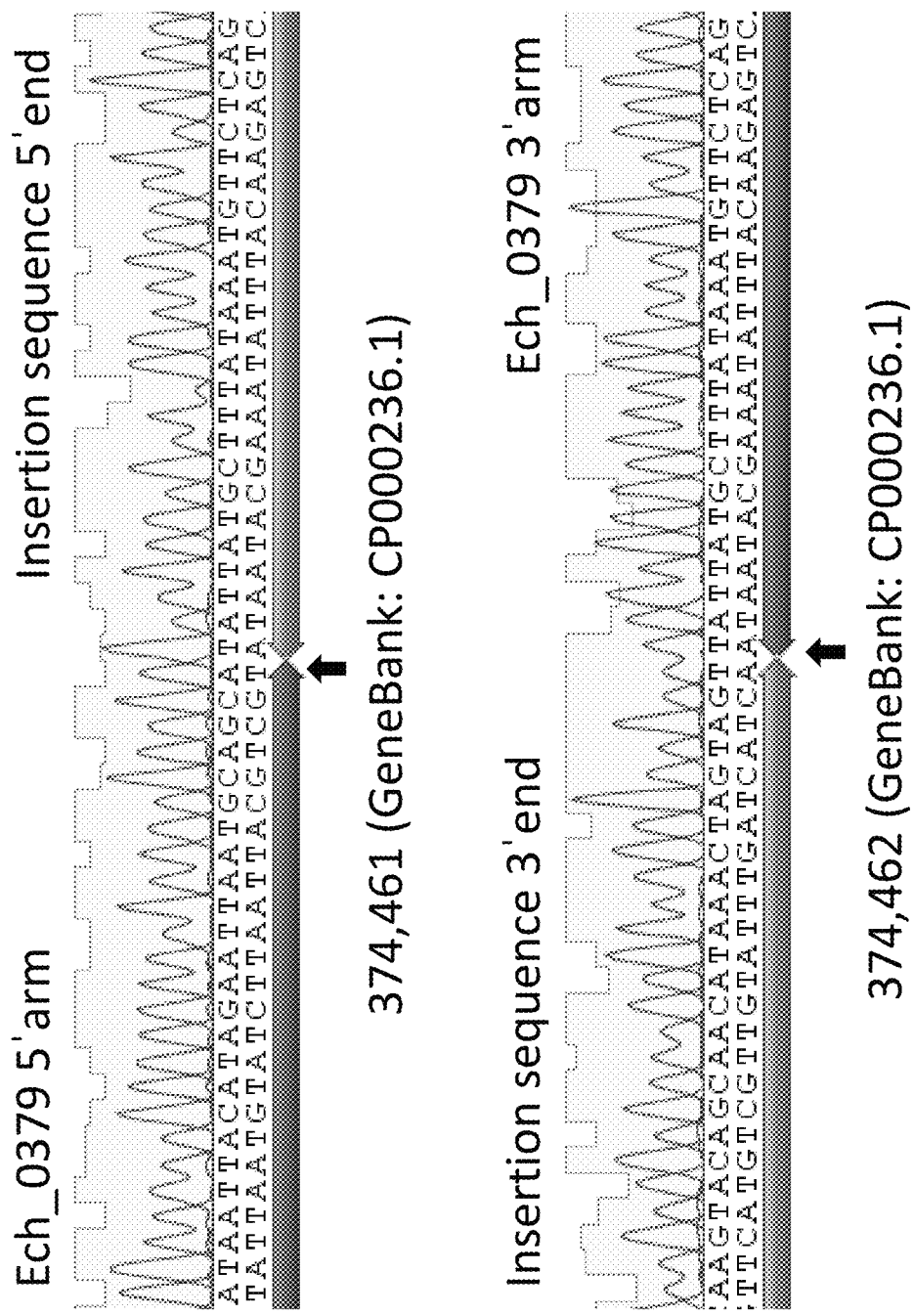
FIG. 5D is a picture showing targeted allelic exchange mutagenesis to restore the Ech_0379 gene. This figure is similar to FIG. 3C except the restriction enzyme and probe used for the Southern blot experiment (shown in FIG. 5E) were Cla I and a DNA segment representing Ech_0379 gene, respectively. Additionally in the top panel of FIG. 5D, the sequence on top is SEQ ID NO. 46 and the sequence on the bottom is SEQ ID NO. 52. In the bottom panel, the top sequence is SEQ ID NO. 47 and the bottom sequence is SEQ ID NO. 53.
Figure 5E:
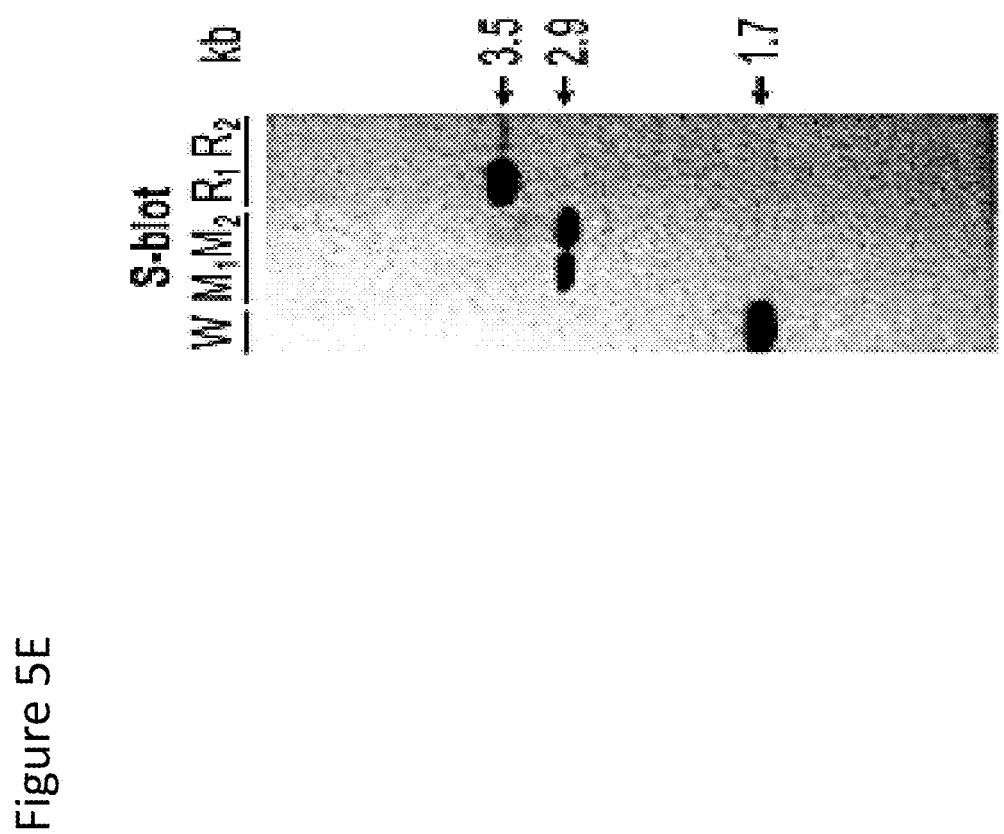
FIG. 5E is a picture of a Southern blot analysis of genomic DNAs (W and M) digested with ClaI (C) or EcoRI (E). The blot analysis was performed with aadA gene segment as the probe illustrates. Lanes $M_1$ and $M_2$ represent data from genomic DNA recovered from the *E. chaffeensis* Ech_0379 mutant culture recovered from DH82 and ISE6 culture, respectively. Similarly, $R_1$ and $R_2$ represent data from genomic DNA recovered from the *E. chaffeensis* Ech_0379 reverted mutant culture recovered from DH82 and ISE6 culture, respectively.
Figure 6B:
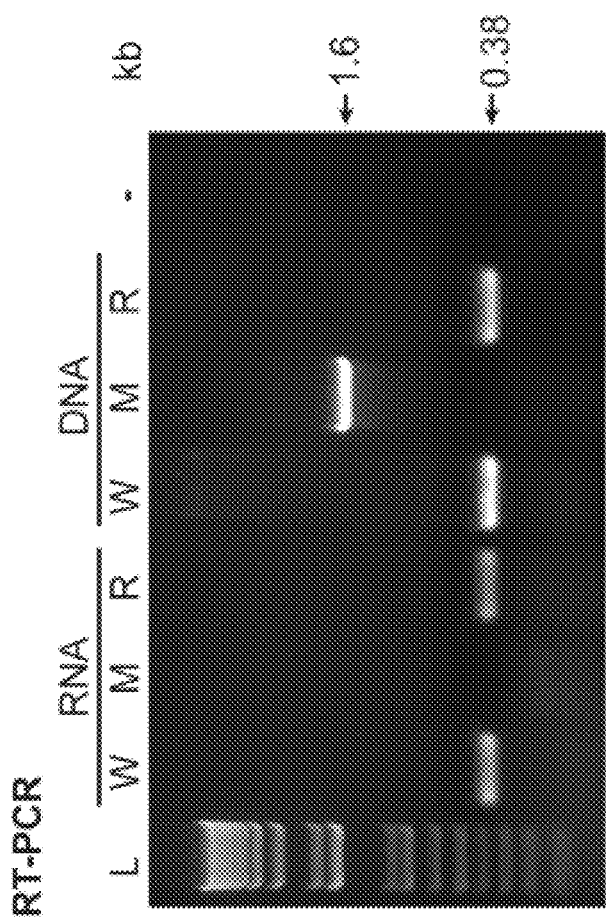
FIG. 6B is similar to FIG. 6A, except that the analysis was performed using RNA recovered from Ech_0379 disruption (M) and restoration (R) mutant organisms. Positive controls for this experiments included genomic DNAs as the templates from W, M and R. (0.38 kb amplicons are expected for DNA templates in PCRs of W and R and 1.6 kb product is expected for M DNA as the template.
Figure 6A:
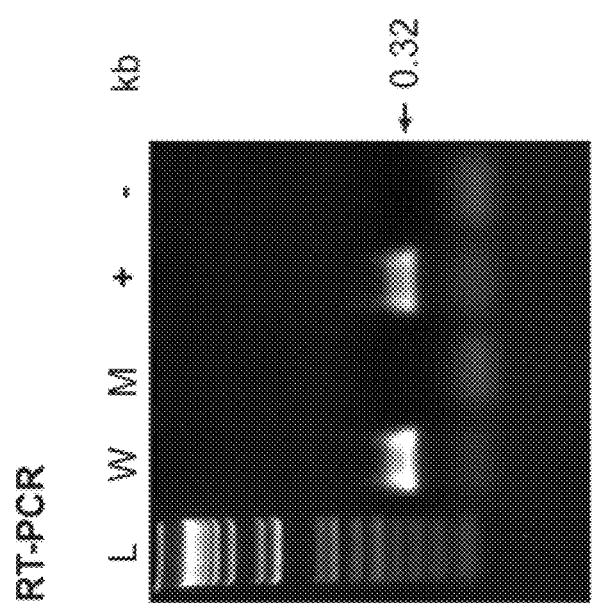
FIG. 6A illustrates transcriptional analysis of RNA recovered from wild type and allelic exchange mutant *E. chaffeensis* organisms assessed by RT-PCR. RT-PCR products from wild type (W) and Ech_0230 mutant (M) organisms were resolved (L, 1 kb plus molecular weight DNA markers resolved; +, genomic DNA from wild type *E. chaffeensis* was used as the template; −, negative control reaction with no template added).
Figure 6C:
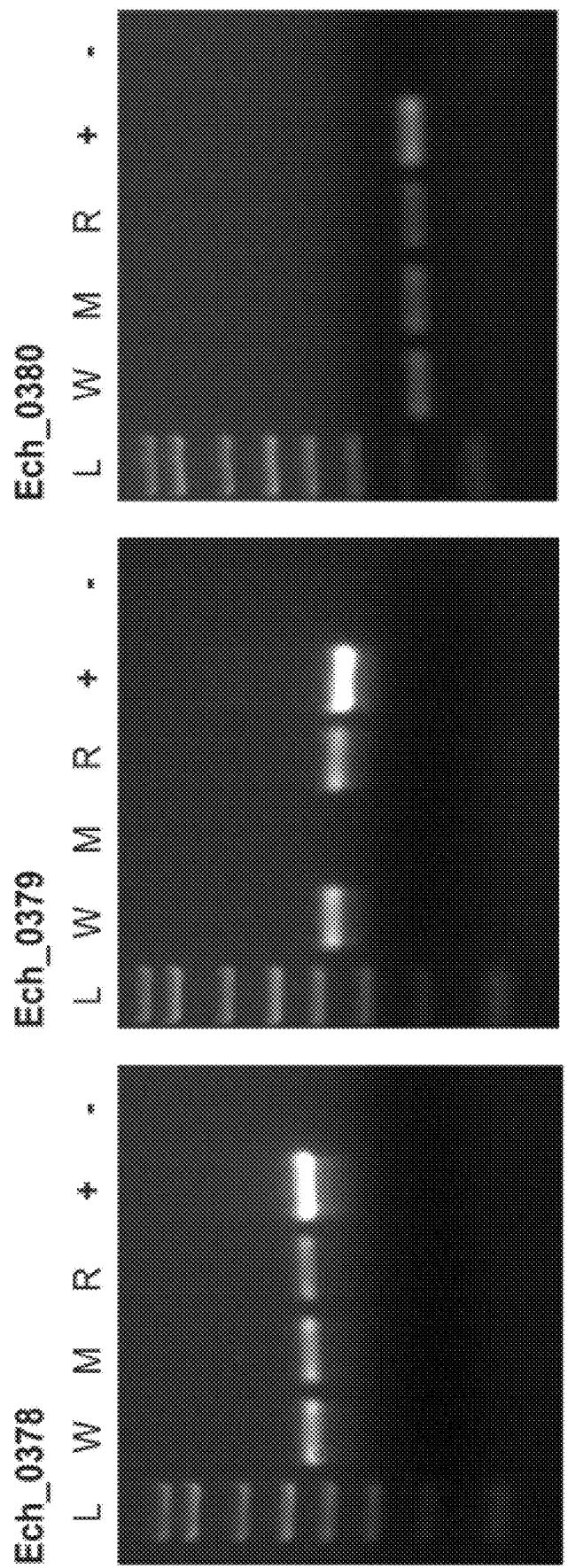
FIG. 6C illustrates transcriptional analysis of RNA recovered from wild type and allelic exchange mutant *E. chaffeensis* organisms assessed by RT-PCR. Mutations to inactivate and restore the gene activity in Ech_0379 did not alter the gene expression from its neighboring genes. Semi-quantitative RT-PCR assays were performed at 30, 35 and 40 PCR cycles for Ech_0378, Ech_0379 and Ech_0380 for wild type, gene inactivation and gene rescue mutant organisms and the data for 35 cycles were presented. W, M and R had similar quantities of amplicons for Ech_0378 and Ech_0380; Ech_0379 amplicons were also similar for W and R, while absent for M.
Figure 7:
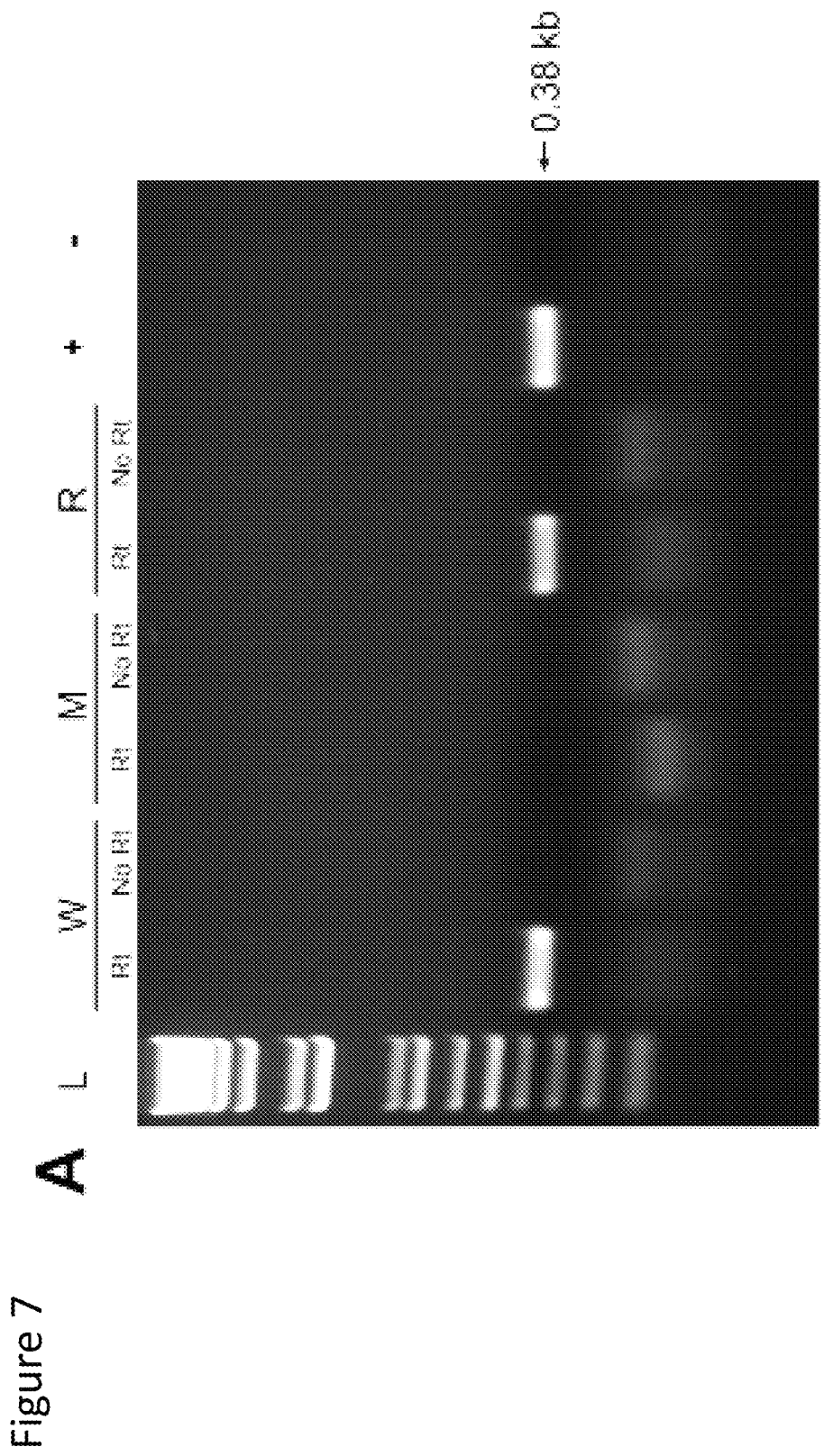
FIG. 7 illustrates phenotypic characterization of Ech_0379 gene in antiporter deficient *E. coli* strain EP432. RT-PCR analysis targeting to Ech_0379 transcripts in EP432 was performed Phenotypic characterization of Ech_0379 gene in antiporter deficient *E. coli* strain EP432.

About 1 kb of *E. chaffeensis* genomic DNA segments upstream and downstream of the previously defined random insertion mutation sites of the Ech_0230 and Ech_0379 gene were obtained by PCR and cloned into a plasmid vector. The promoter segment of *E. chaffeensis* elongation factor Tu gene, Tuf-2, (Ech_0407) was similarly cloned in front of the aadA gene coding sequence into a separate plasmid (aadA gene confers resistance to spectinomycin and streptomycin). Tuf-2 gene promoter (tuf) was chosen for aadA protein expression because it drives the expression of a highly conserved and constitutively expressed protein, Tu that is necessary for the polypeptide elongation process in the protein translation machinery. Further, our bioinformatics analysis and transcription mapping by primer extension experiment suggested that it is a strong promoter responsible for transcribing genes, most of which encode for 30S and 50S ribosomal proteins, and having multiple transcription start sites (not shown). The aadA gene was chosen as it works well in conferring antibiotic resistance in *E. chaffeensis* and in *Anaplasma* species. The tuf-aadA segment was engineered into the homologous recombination constructs of Ech_0230 and Ech_0379 (pHR-Ech_0230-tuf-aadA and pHR-Ech_0379-tuf-aadA, respectively). Linear DNA fragments from the constructs containing the 5' and 3' homology arms of the genes separated by the tuf-aadA segment were generated by PCR for use in creating targeted mutations. To create a rescue mutagenesis template in reversing the targeted gene mutation within the Ech_0379 gene, 0.5 kb fragment downstream from the mutation site of the gene was obtained by PCR from *E. chaffeensis* genome and it was engineered into the pHR-Ech_0379-tuf-aadA construct to generate a modified construct; pHR-res-Ech_0379-Amtr-mCh-Gent containing the entire Ech_0379 gene ORF at the 5' end followed by the presence of the Amtr promoter, the ORFs of mCherry and the gentamicin resistance cassettes (Gent) (Amtr-mCh-Gent) and a 1 kb genomic segment containing the 3' portion of the Ech_0379 gene. Gent was codon optimized for efficient translation in *E. chaffeensis*. Linear fragments from the rescue construct were then prepared which contained the 5'homology arm beginning with the Ech_0379 gene followed by Amtr-mCh-Gent segment and the 3' end genomic segment downstream to the Ech_0379 insertion to serve as the 3' homology arm. Linear DNA fragments to disrupt Ech_0230 or Ech_0379 genes were electroporated into host cell-free wild type *E. chaffeensis* organisms recovered from ISE6 tick cells and then allowed to re-infect ISE6 tick cells. The mutants were selected for their ability to grow in the medium containing spectinomycin and streptomycin for several weeks and then allowed to infect macrophage cell line, DH82, for continued growth for several months. For rescue mutation experiment, linear DNA fragments of the Ech_0379 gene restoration template were similarly electroporated into *E. chaffeensis* organisms containing mutation in the Ech_0379 gene. *E. chaffeensis* cultures with Ech_0379 gene restored were then selected by their ability to grow in the medium containing gentamicin. Following the recovery of *E. chaffeensis* cultures growing in the media containing antibiotics, targeted gene inactivations in Ech_0230 or Ech_0379 were confirmed by two insertion specific PCR assays targeting 1) to the genomic region 5' to the allelic exchange site and to the insertion specific DNA, and 2) to the insertion DNA and to the 3' of the allelic exchange site on the genome. Clonal purity was then confirmed by another PCR assay targeting the genomic regions upstream and downstream of the allelic exchange insertion sites. The integrity of the PCR products was confirmed by PCR-DNA sequence analysis. For Ech_0379 gene restoration mutant generation was also assessed for the mCherry protein expression by fluorescence microscopy (FIG. 5B). The presence of mutations in the *E. chaffeensis* genome was also validated by Southern blot analysis for both the gene disruption mutations and gene restoration mutation. RT-PCR analysis revealed that the Ech_0230 and Ech_0379 transcripts were present in wild type *E. chaffeensis* and were absent in the gene disruption mutant organisms. The complemented mutant strain tested positive for the Ech_0379 transcript similar to wild type *E. chaffeensis*. Further, we tested if the allelic exchange mutations to inactivate and restore gene activity in Ech_0379 can cause polar effects in altering the gene expression from its neighboring genes. The analysis was carried out by semi-quantitative RT-PCR assays where three sets of PCR cycles were used; 30, 35 and 40. Independent of the numbers of PCR cycles performed, RT-PCR products were similar for Ech_0378 and Ech_0380 for wild type, gene inactivation mutant and gene rescue mutant, and Ech_0379 RT-PCR products were absent only in the gene inactivation mutant, while appeared similar for wild type and gene rescue mutant (FIG. 6C). There was no evidence to support the presence of off-target insertions developed during all the three mutational experiments. The Ech_0379 gene open reading frame is completely restored in front of its own promoter resulting from the complementation allelic exchange mutation experiment and its gene structure is, therefore, similar to the wild type *E. chaffeensis*, except that it also expresses mCherry and gentamicin resistance proteins. This modified *E. chaffeensis*, that is similar to wild type in having the complete genome, will be useful for novel studies in monitoring the pathogen in real time by fluorescence imaging in vitro and in vivo, similar to prior studies described for *Borrelia burgdorferi*.

This written description uses examples to disclose the invention, including the best mode, and also to enable any person skilled in the art to practice the invention, including making and using any devices or systems and performing any incorporated methods. The patentable scope of the invention is defined by the claims, and may include other examples that occur to those skilled in the art. Such other examples are intended to be within the scope of the claims if they have structural elements that do not differ from the literal language of the claims, or if they include equivalent structural elements with insubstantial differences from the literal languages of the claims.

EXAMPLES

Example 1

Materials and Methods
In Vitro Cultivation of *E. chaffeensis*.
*E. chaffeensis* Arkansas isolate was continuously cultivated in ISE6 tick cell line, an *I. scapularis* embryonic cell line, as described earlier (Elwell, C., Mirrashidi, K., and Engel, J., *Nat. Rev. Microbial.;* 14, 385-400 (2016). The canine macrophage cell line (DH82) was also used to cultivate *E. chaffeensis* by following the protocols reported earlier (Walker, D. H., Paddocl, C. D. and Dumler, J. S., Med Clin North Am; 92, 1345-1361 (2008)).

Construction for Homologous Recombination Plasmids and Segments.

All the primers used for the preparation of recombinant plasmid constructs developed for the targeted mutagenesis experiments are described in Table 1. Plasmids used and prepared in this study were listed in Table 2.

TABLE 1

List of oligonucleotides used in this study. Uppercase sequences are gene specific; lowercase sequences are Gibson Assembly overlaps.

| Primer* | Sequence | Orientation | Size (bp) |
|---|---|---|---|
| HOMOLOGOUS RECOMBINATION CONSTRUCTS: | | | |
| For Ech_0230 gene disruption | | | |
| Ech_0230 gene segment cloning | | | |
| RRG1591 | TATGGGCCTAAGATAGTATTACC (SEQ ID No. 1) | forward | 2074 |
| RRG1602 | AAGACACACAAGAACATGACACTGCC (SEQ ID No. 2) | reverse | |
| Insertion specific primers to split the plasmid construct of pHR-Ech_0230 | | | |
| RRG1599 | gatcaccaaggtagtcggcaaataactcgagTATATA TAATCATGTATCGATTATATATAACTGTG TGC(SEQ ID No. 3; PRIMER) | forward | 6081 |
| RRG1592 | cctaattaaaaaaagtcaaaattaatagtcacatttttctcga gCTGTAGTACCATGTGTTACTTACCCTCT TTC(SEQ ID No. 4, PRIMER) | reverse | |
| For Ech_0230 gene disruption | | | |
| Ech_0379 gene segment cloning | | | |
| RRG1603 | ACCTGCTGTACTGAGTATGTTCTTG (SEQ ID No. 5) | forward | 2546 |
| RRG1608 | AGACAAGAACATGCTTCAGGTGCTAC (SEQ Id No. 6) | reverse | |
| Insertion specific primers to split the plasmid construct of pHR-Ech_0379 | | | |
| RRG1604 | cctaattaaaaaaagtcaaaattaatagtcacatttttctcga gTGCTGCATTAATTCTATGTAATTATCTTT AG(SEQ ID No. 7-PRIMER) | forward | 6552 |
| RRG1605 | gatcaccaaggtagtcggcaaataactcgagTATTAT GCTTTATAAATGTTCTCAGTCTATTGGC (SEQ ID No. 8-PRIMER) | reverse | |
| For cloning Tuf-2(Ech_0407)promoter | | | |
| RRG1595 | AAAAATGTGACTATTAATTTTGACTTTTTT TAATTAGG(SEQ ID No. 9; PROMOTER) | forward | 387 |
| RRG1596 | gcgatcaccgcttccctcatAAACAAATACCTTTA ACATCATTAAACCATTTC(SEQ ID No. 10; PROMOTER) | reverse | |
| For cloning aadA gene | | | |
| RRG1597 | gaaatggtttaatgatgttaaaggtatttgtttATGAGGG AAGCGGTGATCGC(SEQ ID No. 11) | forward | 789 |

TABLE 1-continued

List of oligonucleotides used in this study.
Uppercase sequences are gene specific; lowercase sequences are Gibson Assembly overlaps.

| Primer* | Sequence | Orientation | Size(bp) |
|---|---|---|---|
| RRG1598 | TTATTTGCCGACTACCTTGGTGATC ID No. 12) | reverse | |
| For Ech_0379 gene function restoration | | | |
| Ech_0379 3' end segment cloning | | | |
| RG8 | GATAATTACATAGAATTAATGCAGCATAT TATGCTTTATAAATGTTCTCAG(SEQ ID No. 13) | forward | 427 |
| RG9 | GCATGCGGCGATCGTTCTAGGAGCTATA AATCTACACTTTCTTCAAC(SEQ ID No. 14) | reverse | |
| For cloning Amtr promoter with mCherry gene(Amtr-mCh) | | | |
| RG10 | CTCCTAGAACGATCGCCGCATGCTAGC (SEQ ID No. 15; PRIMER) | forward | 950 |
| RG11 | AATTTAATCCCTATTTGTATAATTCG (SEQ ID No. 16; PRIMER) | reverse | |
| For cloning gentamycin gene from plasmid pEch_rps1-GENT | | | |
| RG12 | atacaaatagggattaaattATGTTAAGATCATCA AATGATG(SEQ ID No. 17) | forward | 563 |
| RRG914 | ACTACTAGTTTATGTTGCTGTACTTGGAT CAATATC(SEQ ID No. 18) | reverse | |
| Insertion specific primers to split the plasmid construct of pHR-Ech_0379 for rescue construct | | | |
| RG6 | TGCTGCATTAATTCTATGTAATTATCTTTA G(SEQ ID No. 19; PRIMER) | forward | 6499 |
| RG22 | tacagcaacataaactagtagtTATTATGCTTTATA AATGTTCTCAGTCTATTGGC(SEQ ID No. 20; PRIMER) | reverse | |
| PRIMERS FOR MUTANT SCREENING: | | | |
| Ech_0230 disruption mutant | | | |
| PCR I | | | |
| RRG1944 | ATTAGTGCTATGGCATTTGGTC(SEQ ID No. 21) | forward | 1525 |
| RRG1596 | | reverse | |
| PCR II | | | |
| RRG1597 | CAATTTACATGACATACTAACAAGC(SEQ ID No. 22) | forward | 2057 |
| RRG1945 | | reverse | |
| PCR III | | | |
| RRG1944 | | forward | 3582 |
| RRG1945 | | reverse | |
| Ech_0379 disruption mutant | | | |
| PCR I | | | |
| RRG1946 | TGAGTGCTATGATACTCAAAGC(SEQ ID No. 23) | forward | 1779 |
| RRG1596 | | reverse | |
| PCR II | | | |
| RRG1597 | AGAATCAACAAGGCCTACATACC(SEQ ID No. 24) | forward | 2352 |
| RRG1947 | | reverse | |
| PCR III | | | |
| RRG1946 | | forward | 4131 |
| RRG1947 | | reverse | |

TABLE 1-continued

List of oligonucleotides used in this study.
Uppercase sequences are gene specific; lowercase sequences are
Gibson Assembly overlaps.

| Primer* | Sequence | Orientation | Size(bp) |
|---|---|---|---|
| Ech_0379 rescue mutant | | | |
| PCR I | | | |
| RRG1946 | TCCGCAGGATGTTTCACATA(SEQ ID No. 25) | forward | 2243 |
| RG97 | | reverse | |
| PCR II | | | |
| RRG94 | AAGCAAATGCTTTAGGTGCAT(SEQ ID No. 26) | forward | 1711 |
| RRG1947 | | reverse | |
| PCR III | | | |
| RRG1946 | | forward | 4824 |
| RRG1947 | | reverse | |
| SOUTHERN BLOT PROBE AMPLIFICATION PRIMERS: | | | |
| aadA gene probe | | | |
| RRG1200 | GTTACGGTGACCGTAAGGCTT(SEQ ID No. 27; PRIMER) | forward | 603 |
| RRG1201 | CACGTAGTGAACAAATTCTTCCAACTG (SEQ ID No. 28; PRIMER) | reverse | |
| Ech_0379 gene probe | | | |
| RRG1282 | TGAAAATCTGATCGATAGTGCTGTGG (SEQ ID No. 29; PRIMER) | forward | 384 |
| RRG1283 | GGTTGCATTCCCTACAACCTTAG(SEQ ID No. 30; PRIMER) | reverse | |
| RT-PCR PRIMERS: | | | |
| Ech_0230 | | | |
| RG26 | GCTTTGGATTGTTTGTCTTA(SEQ ID No. 31; PRIMER) | forward | 320 |
| RG27 | TCCATCCCATAACAAATCTA(SEQ ID No. 32; PRIMER) | reverse | |
| Ech_0379 | | | |
| RRG1276 | CTAAGGTTGTAGGGAATGCAACC(SEQ ID No. 33; PRIMER) | forward | 376 |
| RRG1277 | ACAAGGTAAGTACCTTGCTTGCTC(SEQ Id No. 34; PRIMER) | reverse | |

*Sequence for the primers was provided only once if a primer is listed multiple times.

TABLE 2

Plasmids and E. coli strains used in this study

| Name | Description | Reference |
|---|---|---|
| pCis mCherry-SS Himar A7 | Himar transposase, mCherry and aadA gene expression driven by Amtr promoter | |
| pHR-Ech_0230 | Ech_0230 homology arms; pCR™2.1-TOPO vector | This study |
| pHR-Ech_0379 | Ech_0379 homology arms, pCR™2.1-TOPO vector | This study |
| pHR-Ech_0230-tuf-aadA | Ech_0230 homology arms, aadA expression driven by tuf-2 promoter, pCR™2.1-TOPO vector | This study |
| pHR-Ech_0379-tuf-aadA | Ech_0379 homology arms, aadA expression driven by tuf-2 promoter, pCR™2.1-TOPO vector | This study |
| pHR-rescue-Ech_0379- | Ech_0379 homology arms, mCherry and gentamycin expression driven | This study |
| Amtr-mCh-Gent | by Amtr promoter, pCR™2.1-TOPO vector | |
| pEch_rpsl-GENT | Codon optimized gentamycin gene for Echrlichia genome, PUC57 vector | GenScript(will submit seq to NCBI) |

Figure 2A:
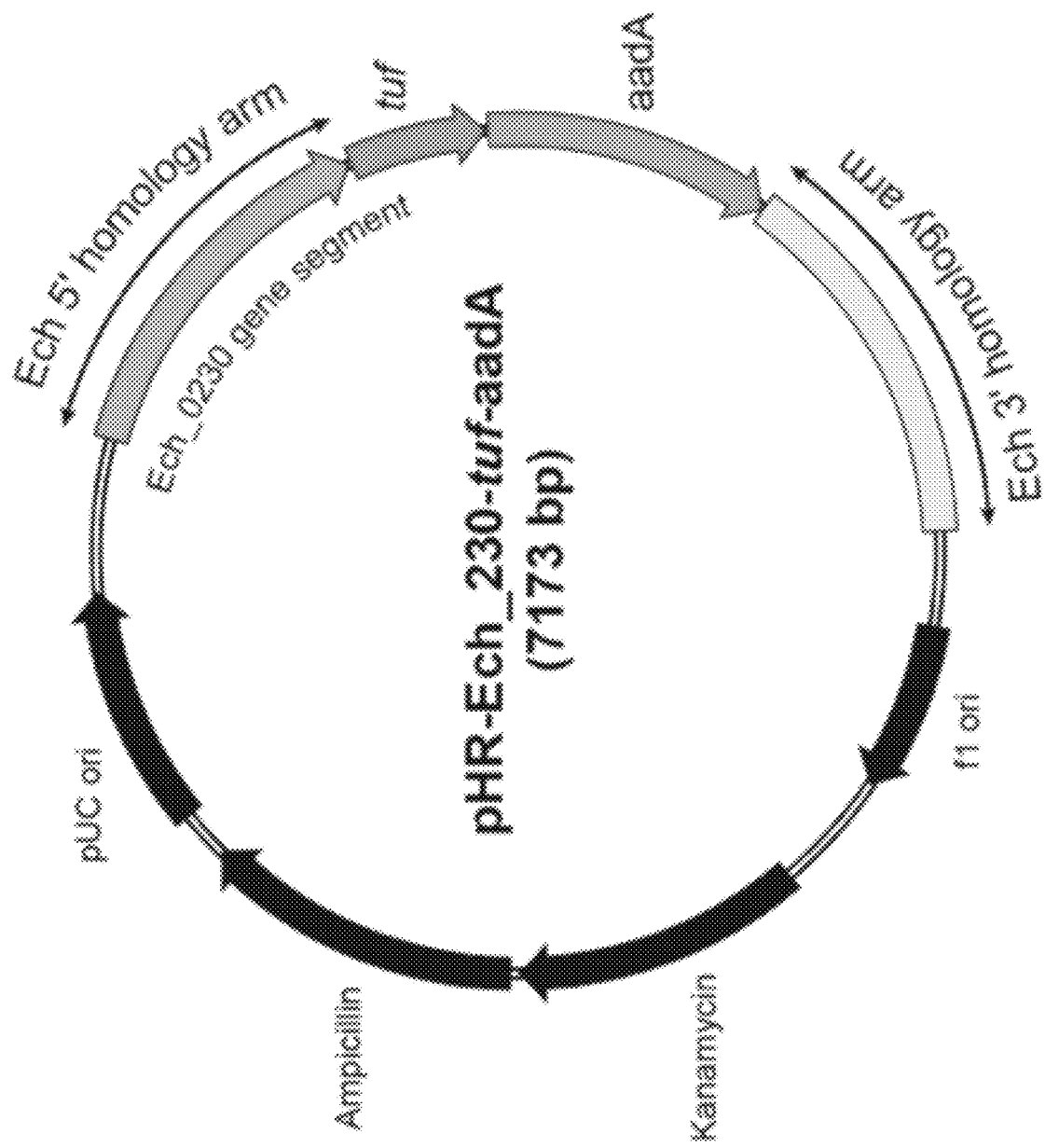
FIG. 2A is a schematic representation of a plasmid map of pHR-Ech_0230-tuf-aadA with an identification of the homology arms. The plasmid sequence data for the construct were deposited in the GenBank (accession #MF068805)
Figure 2B:
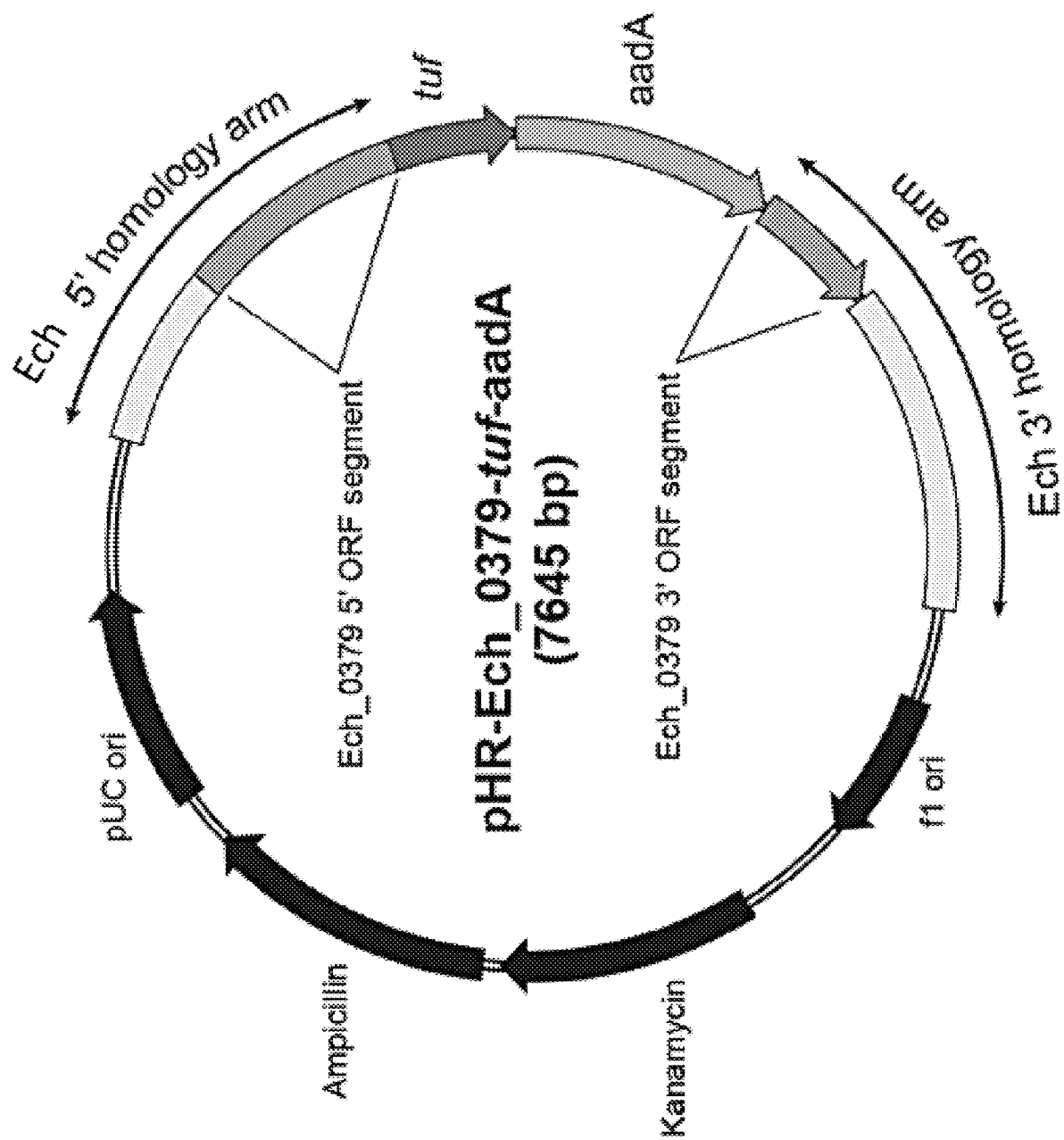
FIG. 2B is a schematic representation of a plasmid map of pHR-Ech_0379-tuf-aadA with an identification of the homology arms. The plasmid sequence data for all the construct were deposited in the GenBank (accession #MF068806).
Figure 3A:
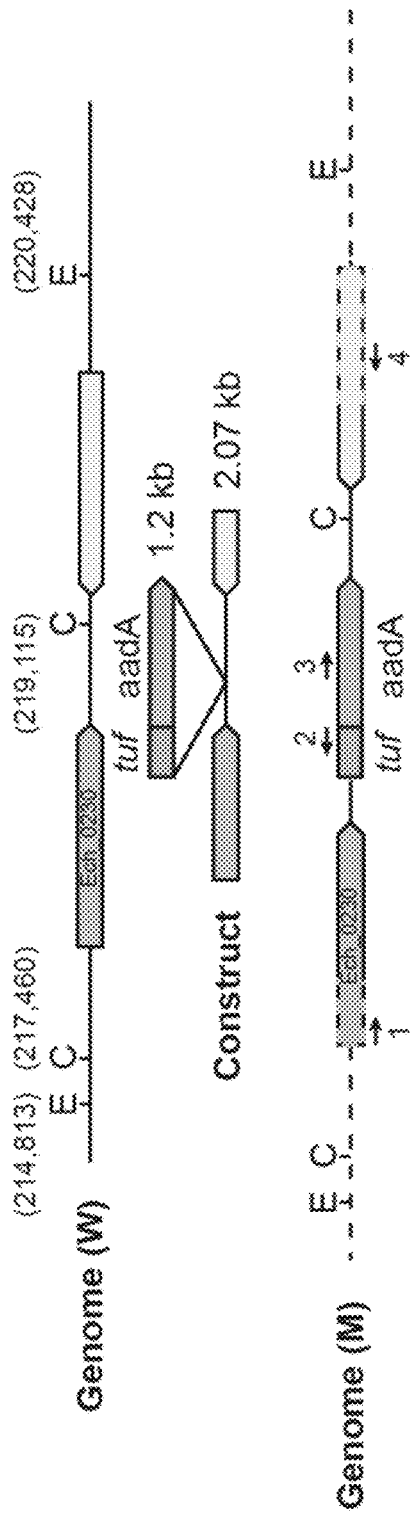
FIG. 3A illustrates targeted allelic exchange mutagenesis to disrupt Ech_0230 gene with FIG. 3A depicting the genomic segment spanning the region selected for preparing an allelic exchange construct, including the restriction enzyme sites (EcoRI (E) and ClaI (C)) used for the mapping the insertion. Genomic coordinates for restriction enzyme sites and the size of inserted fragment (tuf-aadA) were included to allow determination of the expected DNA sizes in PCR and Southern blot analysis.
Figure 3B:
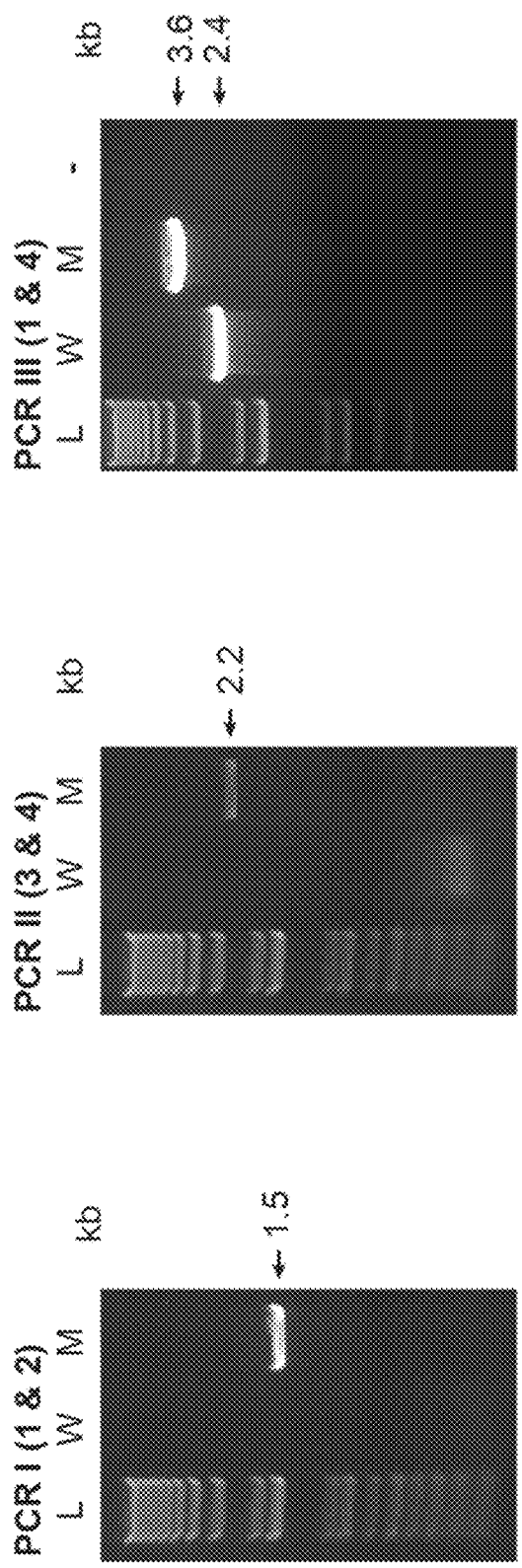
FIG. 3B is a picture showing amplicons resolved following three different PCRs using primers targeting to the genomic regions upstream and downstream to the allelic insertion (primers identified as 1 and 4) and to the inserted DNA (primers; 2 and 3). (L, 1 kb plus molecular weight DNA markers; Wild Type (W), PCR with wild type genomic DNA as the template; Mutant (M), PCR with mutant genomic DNA as the template).
Figure 3C:
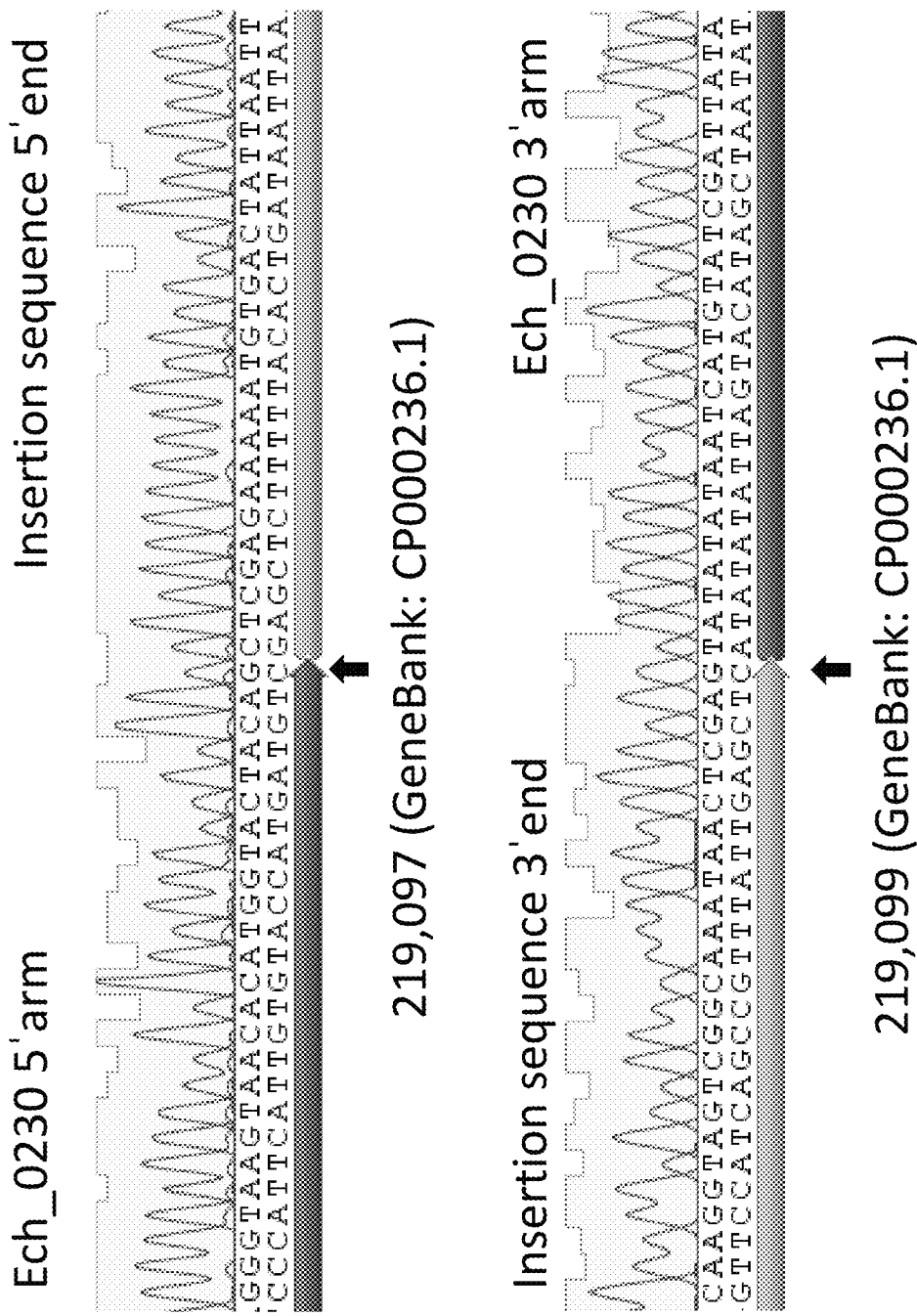
FIG. 3C is an illustration showing PCR DNA Sequence verification of insertion sites in the targeted mutant. In the top panel, the DNA sequence generated from amplicons shown above and to the left of the black arrow represents the sequence from *E. chaffeensis* genome, while the sequence above and to the right of the black arrow represents the inserted sequence in the gene disruption mutant. In the bottom panel, the DNA sequence generated from amplicons shown above and to the right of the black arrow represents the sequence from *E. chaffeensis* genome, while the sequence above and to the left of the black arrow represents the inserted sequence in the gene disruption mutant. Sequences boundaries at the 5' and 3' insertion junctions were identified with a small black arrow lines. Additionally in this top panel, the sequence on top is SEQ ID NO. 42 and the sequence on the bottom is SEQ ID NO. 48. In the bottom panel, the top sequence is SEQ ID NO. 43 and the bottom sequence is SEQ ID NO. 49.
Figure 3D:
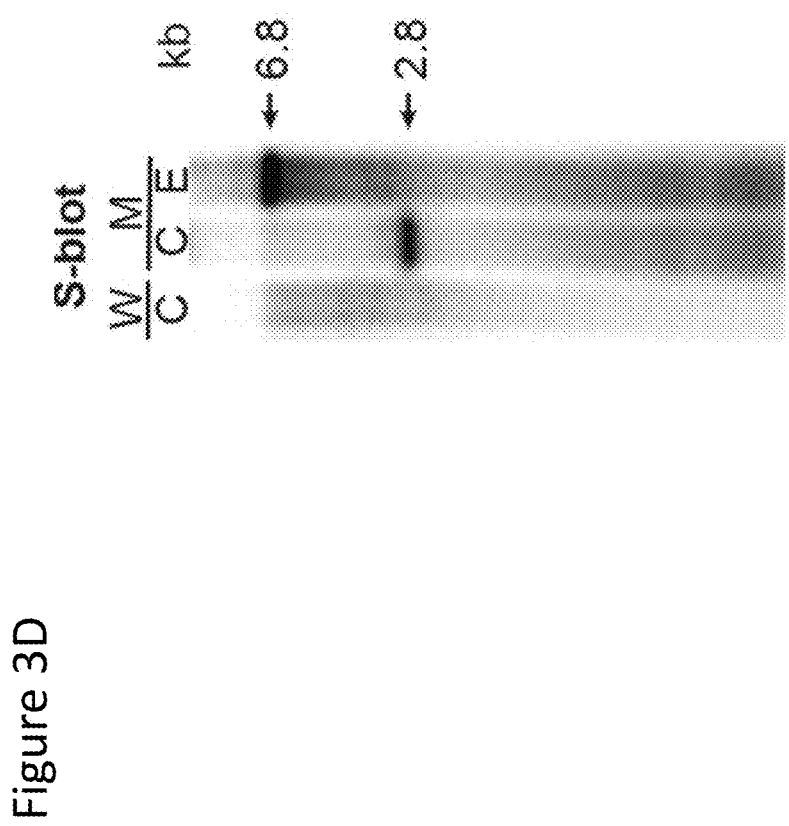
FIG. 3D is a picture of a Southern blot analysis of genomic DNAs (W and M) digested with ClaI (C) or EcoRI (E). The blot analysis was performed with aadA gene segment as the probe.
Figure 4A:
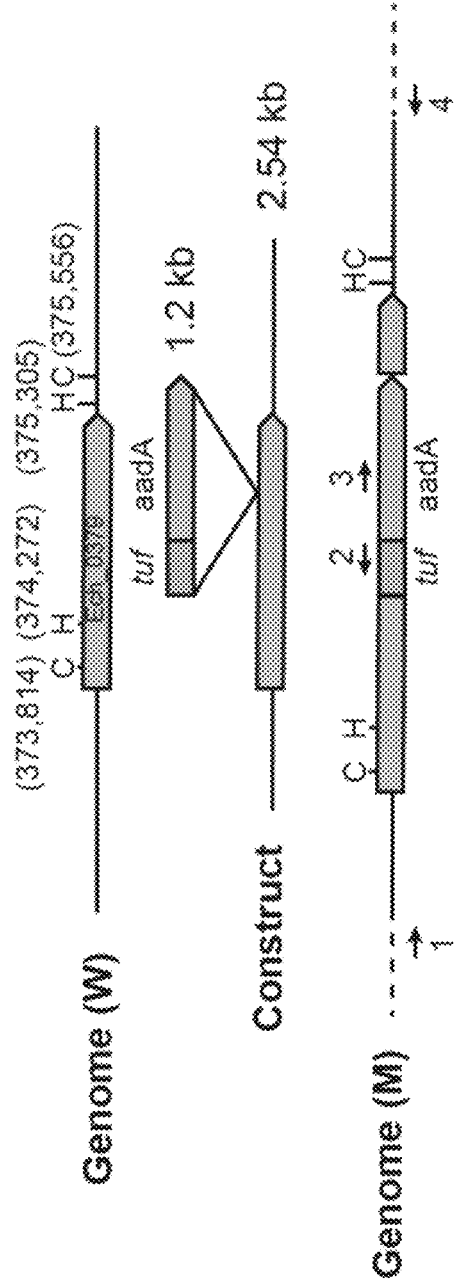
FIG. 4 illustrates targeted allelic exchange mutagenesis to disrupt Ech_0379 gene with FIG. 4A depicting the genomic segment spanning the region selected for preparing an allelic exchange construct, including the restriction enzyme sites (ClaI (C) and HindIII (H)) used for the mapping the insertion. Genomic coordinates for restriction enzyme sites and the size of inserted fragment (tuf-aadA) were included to allow determination of the expected DNA sizes in PCR and Southern blot analysis.
FIG. 4B is a picture showing amplicons resolved following three different PCRs using primers targeting to the genomic regions upstream and downstream to the allelic insertion (primers identified as 1 and 4) and to the inserted DNA (primers; 2 and 3). (L, 1 kb plus molecular weight DNA markers; Wild Type (W), PCR with wild type genomic DNA as the template; Mutant (M), PCR with mutant genomic DNA as the template).
FIG. 4C is an illustration showing PCR DNA Sequence verification of insertion sites in the targeted mutant. In the top panel, the DNA sequence generated from amplicons shown above and to the left of the black arrow represents the sequence from *E. chaffeensis* genome, while the sequence above and to the right of the black arrow represents the inserted sequence in the gene disruption mutant. In the bottom panel, the DNA sequence generated from amplicons shown above and to the right of the black arrow represents the sequence from *E. chaffeensis* genome, while the sequence above and to the left of the black arrow represents the inserted sequence in the gene disruption mutant. Sequences boundaries at the 5' and 3' insertion junctions were identified with a small black arrow lines. Additionally in this top panel, the sequence on top is SEQ ID NO. 44 and the sequence on the bottom is SEQ ID NO. 50. In the bottom panel, the top sequence is SEQ ID NO. 45 and the bottom sequence is SEQ ID NO. 51.
FIG. 4D is a picture of a Southern blot analysis of genomic DNAs (W and M) digested with ClaI (C) and HindIII (H). The blot analysis was performed with aadA gene segment as the probe.
Figure 4B:
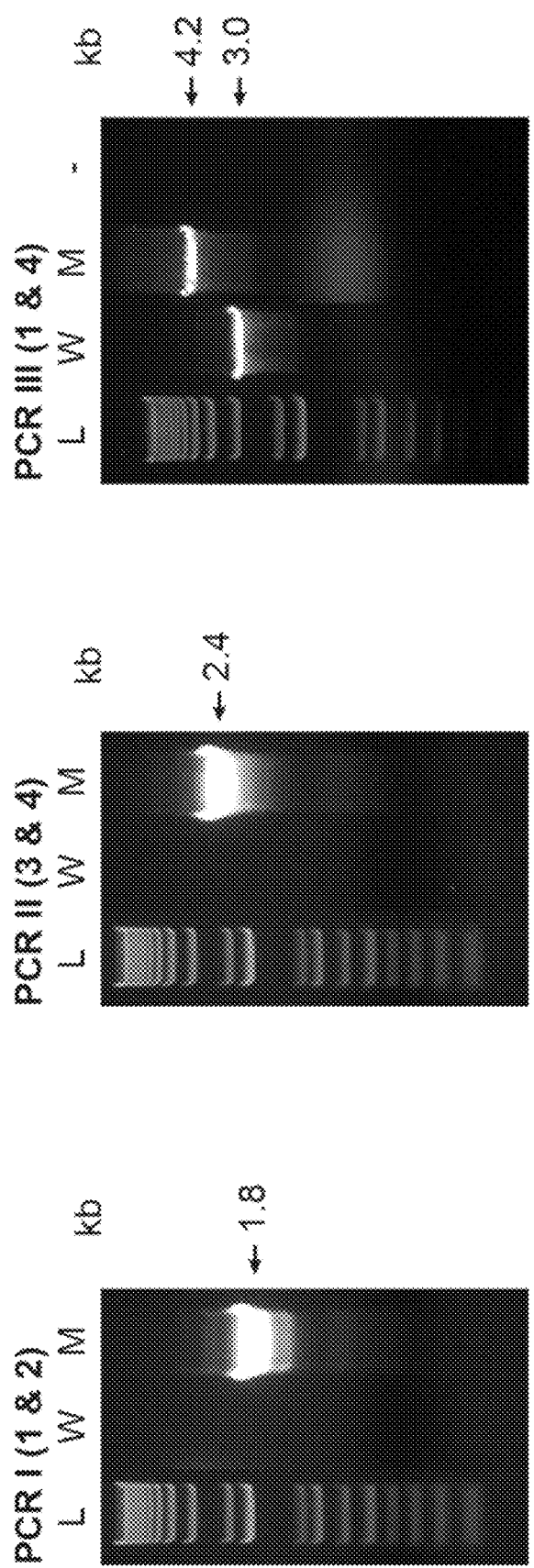
Figure 4C:
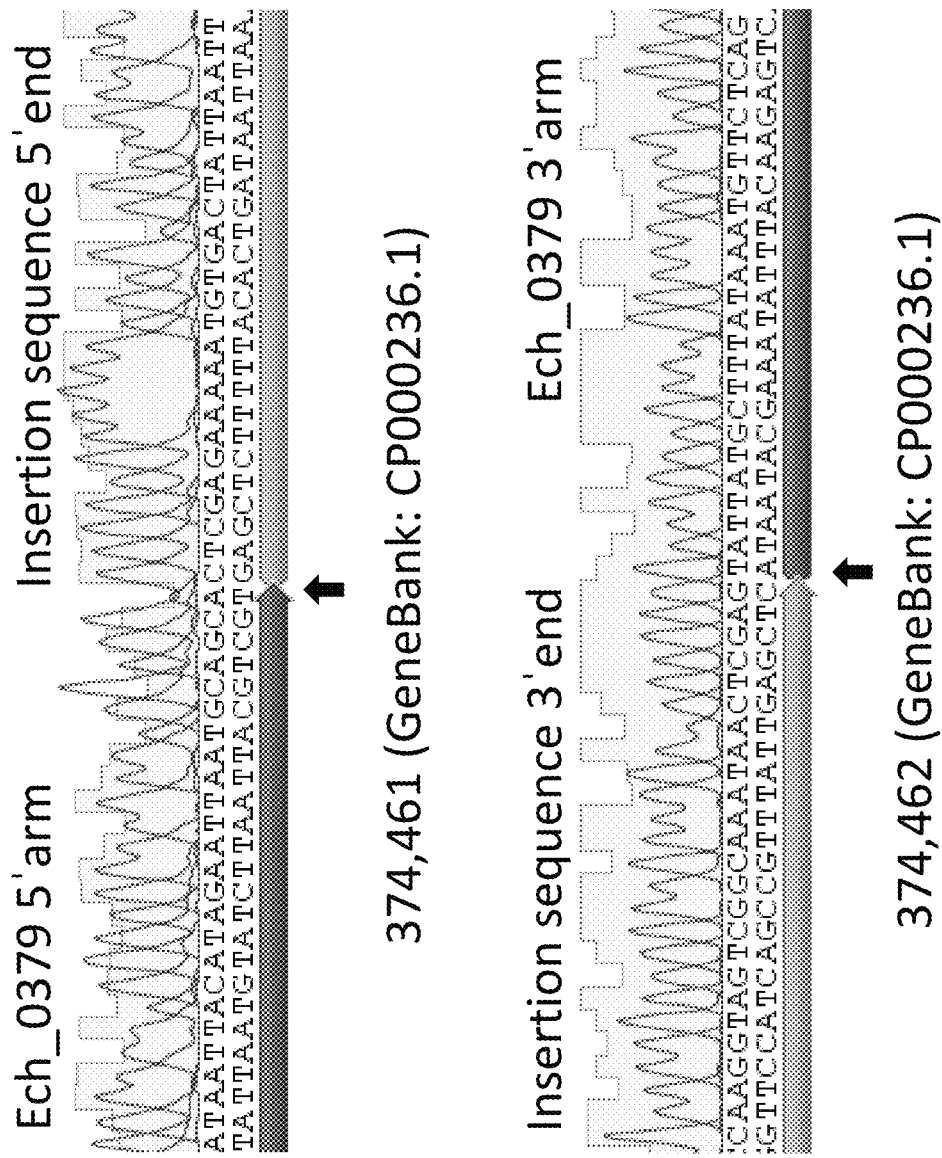
Figure 4D:
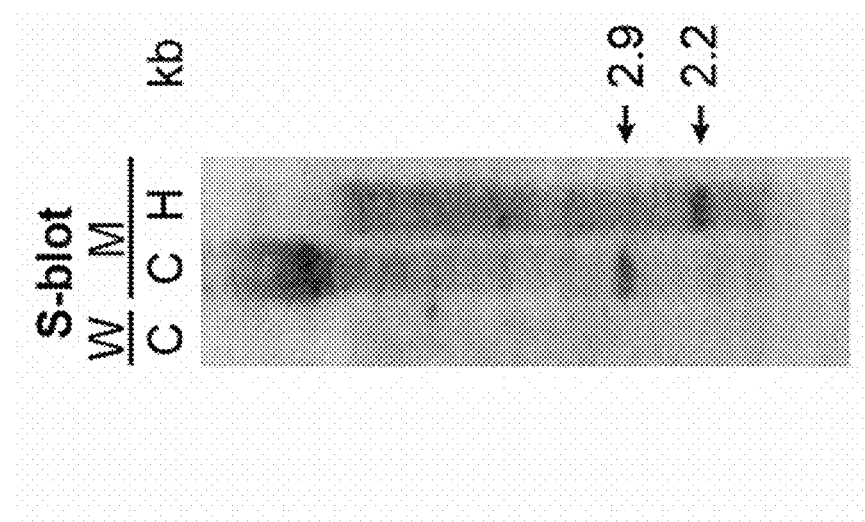

An illustration of the detailed molecular steps followed in preparing the constructs for allelic exchange mutagenesis experiments are depicted in FIG. 1. The Platinum® Taq DNA Polymerase High Fidelity (Invitrogen, Carlsbad, Calif.) was used in all PCR experiments while preparing the constructs. Ech_0230 and Ech_0379 genes of *E. chaffeensis* were used to create allelic exchange mutations as we previously reported random mutations within these genes by Himar1 random mutagenesis method and that the mutant organisms grow normally under in vitro cultures. About 2.0 kb genomic DNA segments spanning about 1 kb each from both sides of the previously identified mutation insertion sites of the genes (referred as A and A' in FIG. 1) were amplified from E. chaffeensis genome (GenBank #CP000236.1; Himar1 mutation insertion sites for Ech_0230 and EcH_0379 are 219,097 and 374,461, respectively). Genome coordinates of the amplified segments of Ech_0230 and Ech_0379 genes are 218,060 to 220,133 and 373,265 to 375,810, respectively. The amplicons were first cloned into the plasmid, pCR™2.1-TOPO TA vector (Life Technologies, Rockville, Md.) by following manufacturer instructions. Tuf-2 gene (Ech_0407) promoter (tuf) spanning 0.37 kb DNA was also amplified from the E. chaffeensis genome (genome coordinates of this segment are 396,385 to 396,751) for use in constitutive expression of the aadA gene product to confer resistance to spectinomycin and streptomycin. The aadA gene open reading frame (ORF) was obtained by PCR from pCis mCherry-SS Himar A7 plasmid (Sahni, S. K., Narra, H. P., Sahni, A., and Walker, D. H.; Future Microbiol; 8, 1265-1288 (2013).) The tuf promoter and aadA ORF were also cloned into a separate pCR™2.1-TOPO TA vector and the plasmid was then used to generate linear fragments of tuf-aadA segment (fragment 1) for incorporation into the final targeted gene disruption mutagenesis constructs. Linear fragments were then generated from the entire plasmids (pHR-Ech_0230 and pHR-Ech_0379 respectively) containing the gene segments using Ech_0230 or Ech_0379 gene specific primers designed to split these gene fragments to two equal halves positioned at each end of the linear fragments and keeping the plasmid backbone in the middle (fragment 2). By following the protocols of Gibson Assembly method (New England Biolabs, Ipswich, Mass.), the linear fragments 1 and 2 were then ligated to create the final homologous recombinant plasmid constructs, where the gene segments were disrupted with the insertion of tuf-aadA segments. The final constructs were named as pHR-Ech_0230-tuf-aadA and pHR-Ech_0379-tuf-aadA, respectively (FIGS. 2A and 2B, respectively). (GenBank submission #s 2012015 and 2012023; accession numbers are yet to be received.) Subsequently, linear fragments from these constructs containing both the 5' and 3' homology arms of each gene disruption segments along with the tuf-aadA cassette were generated by PCR (FIG. 3A). The amplicons were then resolved on a 1% agarose gels (FIG. 3B); DNAs were gel isolated and concentrated to 1 µg/µl in nuclease free water for use in the allelic exchange mutagenesis experiments to create targeted gene disruptions.

Figure 2C:
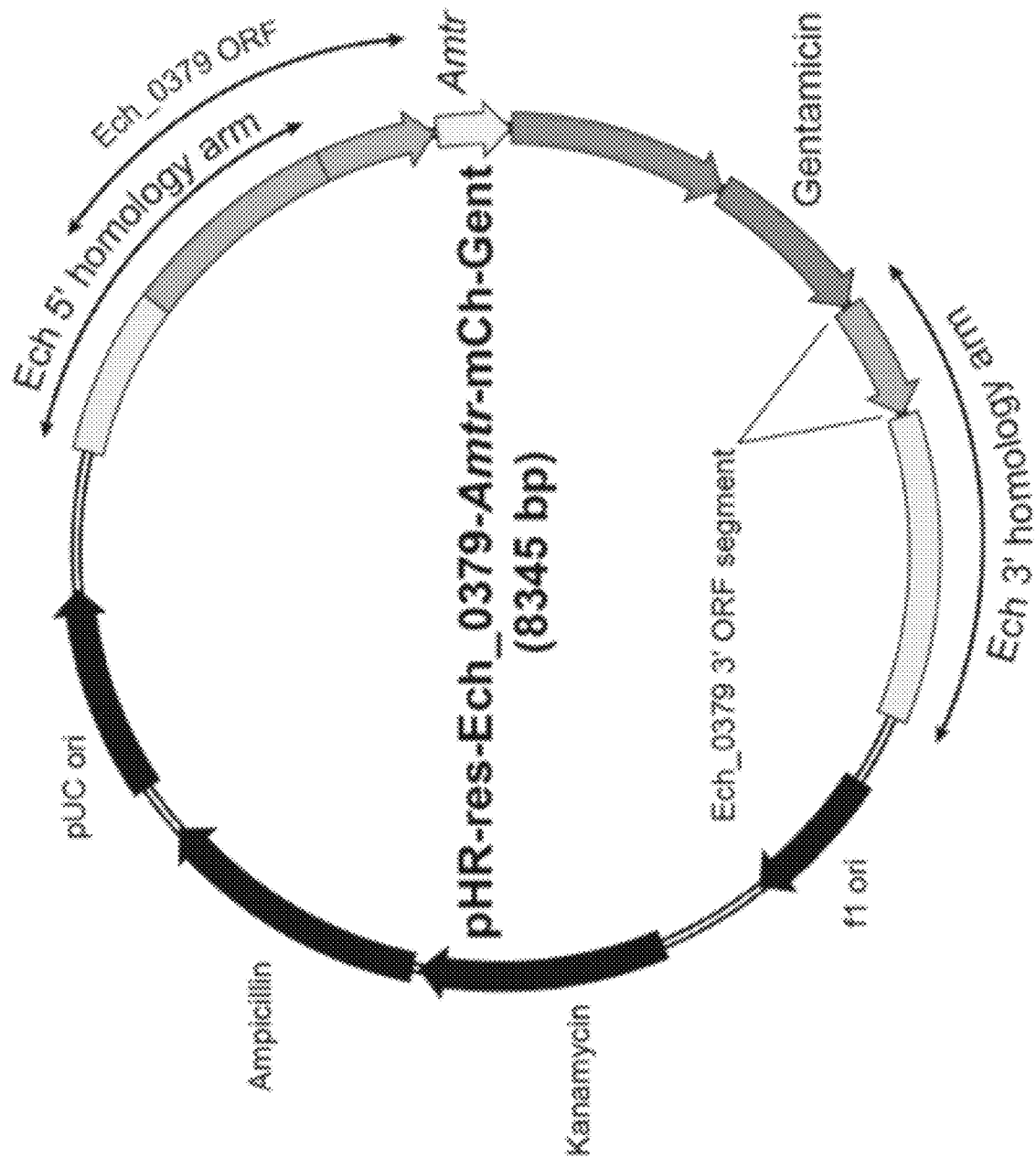
FIG. 2C is a schematic representation of a plasmid map with an identification of the homology arms. The plasmid sequence data for the construct was deposited in the GenBank (accession #MF068807).

For constructing the Ech_0379 gene function rescue template, the 3' end 0.5 kb fragment downstream from the mutation site by PCR using E. chaffeensis genomic DNA was generated as the template (genomic coordinates are 374,462 to 374,837). The Amtr-mCherry (Amtr-mCh) DNA segments constituting the Anapmasma marginale transcription regulator (Tr) gene promoter and mCherry ORF were amplified using pCis mCherry-SS Himar A7 plasmid as the template. The gentamicin resistance gene coding sequence (Gent) was codon optimized commercially (GenScript, Piscataway, N.J.) (GenBank #KY977452) as per the frequently found codons of E. chaffeensis genome. The Gent segment was then used to clone downstream to Amtr-mCh fragment to generate Amtr-mCh-Gent fusion fragment. The 3' end 0.5 kb Ech_0379 segment was then ligated at the 5' end of the Amtr-mCh-Gent fragment by performing overlapping PCR and the final amplicon was subsequently cloned into the Ech_0379-tuf-aadA-HR 1 construct to replace the tuf-aadA segment with Amtr-mCh-Gent segment containing the 3' end 0.5 kb Ech_0379 ORF segment by performing the Gibson Assembly cloning strategy. The final Ech_0379 rescue plasmid construct; pHR-res-Ech_0379-Amtr-mCh-Gent included the full length Ech_0379 ORF restored in front of its own promoter, followed by the Amtr-mCh-Gent and the 3' end 1 kb genomic segment of Ech_0379 gene (FIG. 2C) (GenBank submission #2012033; accession number is yet to be received). This construct was then used as the template to generate linear fragments by PCR which contained the entire Ech_0379 gene at the 5' end, including its own promoter and the complete ORF, followed by Amtr-mCh-Gent segment and the additional 3' end 1 kb segment downstream from Ech_0379 gene mutation site (FIG. 5A). The PCR product was purified by QIAquick PCR Pruification Kit (Qiagen, Hilden, Germany) and concentrated to 1 µg/µl in nuclease-free water as outlined above for use in the allelic exchange mutagenesis experiment to restore the integrity of the gene in E. chaffeensis organisms having Ech_0379 gene disruption.

Purification of Cell-Free E. chaffeensis Organisms.

Five ml of E. chaffeensis cell culture from about 80-90% infected confluent ISE6 cell culture flask was used to generate host cell-free E. chaffeensis organisms. Briefly, the infected cell suspension was recovered by centrifugation at 15,000 g for 10 min at 4° C. and after discarding the supernatant, 1.5 ml of ice-cold 0.3 M sucrose solution and 100 µl volume of autoclaved rock tumbler grit #1 (60/90 grit silicon carbide, Lortone, Wash.) were added to the cell pellet and votexed using a table top vortexer at maximum speed for 30 sec to release bacteria from the infected host cells. The cell suspension was then centrifuged at 200 g for 10 min at 4° C. to pellet the host cell debris. The supernatant was carefully recovered into a 3 ml syringe and passed through a 1.6 µm filter (Whatman Ltd., Piscataway, N.J.); the filtrate containing E. chaffeensis organisms were pelleted by centrifuging at 15,000 g for 10 min at 4° C. The cell pellet was washed twice with 0.3 M ice-cold sucrose solution resuspended in 45 µl of 0.3 M ice-cold sucrose solution and used immediately for electroporation experiments.

Transformation of E. chaffeensis and Clonal Isolation of Mutants.

Between 3-10 µg of purified linear DNA fragments from the allelic exchange mutagenesis plasmid constructs (outlined above) were added to the host cell-free E. chaffeensis organisms in 45 µl volume, mixed gently and transferred the contents into a 1 mm gap electroporation cuvette (Bio-Rad Laboratories, Hercules, Calif.). The cuvette was incubated on ice for 15 min and then subjected to electroporation at 2,000 volts, 25 µF and 400 S2 setting (Gene Pulser Xcell™, Bio-Rad Laboratories, Hercules, Calif.). The electroporated cells were transferred to a micro centrifuge tube containing 0.5 ml of FBS and 1 ml of uninfected ISE6 cell suspension containing about $1 \times 10^6$ ISE6 cells in tick cell culture infection media. The mixed sample was centrifuged at 5,000 g for 5 min, incubated at room temperature for 15 min, cells were then resuspended in 5 ml culture media and the entire contents were transferred to a T25 flask containing confluent ISE6 cells and incubated for 24 h in a humidified 34° C. incubator and then 100 µg/ml each of spectinomycin and streptomycin were added to the culture medium; incubations were continued at 34° C. for several weeks to select mutants. Typically, mutants were detected by PCR analysis after two to three weeks, although the assessment continued for several weeks beyond this time point. Similar experiment was carried out to obtain Ech_0379 gene restoration mutant, except that the media containing 80 µg/ml of gentamicin were used after 24 h of electroporation. Ech_0379 gene restoration mutant cultures were also assessed by detecting the expression of mCherry by examining the cultures using a Nikon Diaphot inverted microscope (Nikon, Melville, N.Y.). Once identified, the antibiotic resistant cultures were transferred to DH82 cell cultures for further growth and maintenance. Liquid nitrogen stocks were also prepared and stored within the first two weeks after the establishment of mutant strains.

Confirming the Presence of *E. chaffeensis* Mutants.

The cultures of *E. chaffeensis* which grew well in the presence of antibiotics were subsequently screened for allelic exchange mutation positives by genomic DNA analysis by insertion specific PCRs. Total genomic DNAs were recovered from the cultures using a Wizard Genomic DNA Purification Kit as per the manufacturer's instructions (Promega, Madison, Wis.). Three different PCR assays were performed using the purified genomic DNAs (FIG. 4B). The first and second PCR assays (FIG. 4B first panel) targeted to 1) the genomic region 5' to the allelic exchange sites and to the insertion specific DNA (FIG. 4B second panel) the insertion DNA and to the 3' of the allelic exchange sites on the genome. The $3^{rd}$ PCR assay (FIG. 4B third panel) was designed to also test the clonal purity of mutants; primers used in this assay were targeted to the genomic regions upstream and downstream of the allelic exchange insertion sites (FIG. 4C). The PCR products were resolved on a 0.9% agarose gel to identify specific predicted length amplicons and then subjected to sequencing analysis to further confirm the integrity by mapping the genomic junctions of the insertions from both ends of the amplicons. Mutations and clonal purity was subsequently confirmed by Southern blot analysis (FIG. 4D). Genomic DNAs from the mutant organisms and from wild-type organisms were subjected to restriction enzyme digestions using ClaI, EcoRI or HindIII restriction enzymes; the digested DNAs were resolved on a 1% agarose gel and transferred to a nylon membrane (Roche Diagnostics, Indianapolis, Ind.). The insertion specific aadA gene segment probe was used in the Southern blot hybridization experiment to locate inserted DNA in targeted disrupted mutants of Ech_0230 and Ech_0379, while Ech_0379 gene segment probe was used for locating the genomic insertions in targeted gene insertion and restoration mutant clones of Ech_0379 as per standard procedures of DNA blot analysis.

RNA Analysis by RT-PCR to Verify the Loss and Restoration of Transcription.

Total RNAs from wild type and mutant *E. chaffeensis* organisms grown in ISE6 or DH82 cell cultures were isolated by following the Tri-reagent total RNA isolation method as per the manufacturer's instructions (Sigma-Aldrich, St. Louis, Mo.). The RNA samples were then treated with RQ1 DNase (Promega, Madison, Wis.) at 37° C. for 60 min to remove any residual genomic DNAs. Primers targeting to Ech_0230 or Ech_0379 ORF were used in RT-PCR analysis and the presence of specific amplicons was assessed by 0.9% agarose gel analysis and by subjecting the products to DNA sequence analysis. Semi quantitative RT-PCR assays were performed as we previously described for assessing the mRNA expression from the genes Ech_0378, Ech_0379 and Ech_0380 using equal quantities of *E. chaffeensis* RNAs recovered from wild type, Ech_0379 gene disruption, and Ech_0379 gene restoration mutants (FIGS. 5B, 5C, 6A, and 6B). The assays were performed at 30, 35 and 40 cycles (FIG. 6C). Southern blot was used to confirm (FIG. 5E).

Example 2

Materials and Methods In vitro cultivation of *E. canis* and *Anaplasma phagocytophilum*. *E. canis* and *A. phagocytophilum* are continuously cultivated in ISE6 tick cell line, an *I. scapularis* embryonic cell line, as described earlier (Munderloh, U. G. et al. J. Clin. Microbiol. 37, 2518-2524 (1999) and Cheng, C. & Ganta, R. R. *Curr. Protoc. Microbiol.* Chapter 3, Unit 3A 1 (2008)).

Construction for Homologous Recombination Plasmids and Segments.

All the primers used for the preparation of recombinant plasmid constructs are developed for the targeted mutagenesis experiments by following similar protocols as we described for *E. chaffeensis*, except that the pathogens' gene target specific primers are used. Similarly, the detailed molecular steps followed in preparing the constructs for allelic exchange mutagenesis experiments are similar to those depicted for *E. chaffeensis* by following standard molecular methods (Sambrook, J. & Russell, D. W. Molecular cloning: a laboratory manual. Cold Spring Harbor Laboratory, Cold Spring Harbor, N.Y. (2001)). Briefly, about 2.0 kb genomic DNA segments spanning about 1 kb each from both sides of the previously identified mutation insertion sites of the genes are amplified from *E. canis* or *A. phagocytophilum* gene homologs that are similar to *E. chaffeensis* gene Ech_0660. The Ech_0660 homolog sequences of *E. canis* and *A. phagocytophilum* are provided herein as SEQ ID NO. 54 and SEQ ID NO. 55, respectively. The amplicons are first cloned into a plasmid vector and the *Ehrlichia* or *Anaplasma* gene promoter driving antibiotic selection marker gene, along with a fluorescent reporter gene are inserted into the final targeted gene disruption mutagenesis constructs to split the sequence of the bacteria to about equal halves. Linear fragments are then generated by PCR from the entire recombinant plasmids containing *E. canis*- or *A. phagocytophilum*-specific disruption gene segments. The amplicons are then purified and concentrated to 1 μg/μl in nuclease free water for use in the allelic exchange mutagenesis experiments to create targeted gene disruptions.

Purification of Cell-Free *E. canis* and *A. phagocytophilum* Organisms.

Purification method to recover host cell-free organisms of *E. canis* or *A. phagocytophilum* is essentially the same as *E. chaffeensis* described above in Example 1 except that the infected 80-90% infected confluent ISE6 cell culture flasks containing *E. canis* or *A. phagocytophilum* are used, respectively, to generate the specific host cell-free organisms by following the protocol as in Felsheim, R. F. et al. *BMC Biotechnol.* 6, 42 (2006).

Transformation of *E. chaffeensis* and Clonal Isolation of Mutants.

Three μg of purified linear DNA fragments from the allelic exchange mutagenesis plasmid constructs (outlined above) were added to the host cell-free *E. chaffeensis* organisms in 45 μl volume, mixed gently and transferred the contents into a 1 mm gap electroporation cuvette (Bio-Rad Laboratories, Hercules, Calif.). The cuvette was incubated on ice for 15 min and then subjected to electroporation at 2,000 volts, 25 μF and 400 S2 setting (Gene Pulser Xcell™, Bio-Rad Laboratories, Hercules, Calif.). The electroporated cells were transferred to a micro centrifuge tube containing 0.5 ml of FBS and 1 ml of uninfected ISE6 cell suspension containing about $1\times10^6$ ISE6 cells in tick cell culture infection media. The mixed sample was centrifuged at 5,000 g for 5 min, incubated at room temperature for 15 min, cells were then resuspended in 5 ml culture media and the entire contents were transferred to a T25 flask containing confluent ISE6 cells and incubated for 24 h in a humidified 34° C. incubator and then 100 µg/ml each of spectinomycin and streptomycin were added to the culture medium; incubations were continued at 34° C. for several weeks to select mutants. Typically, mutants were detected by PCR analysis after two to three weeks, although the assessment continued for several weeks beyond this time point. Similar experiment was carried out to obtain Ech_0379 gene restoration mutant, except that the media containing 80 µg/ml of gentamicin were used after 24 h of electroporation. Ech_0379 gene restoration mutant cultures were also assessed by detecting the expression of mCherry by examining the cultures using a Nikon Diaphot inverted microscope (Nikon, Melville, N.Y.). Once identified, the antibiotic resistant cultures were transferred to DH82 cell cultures for further growth and maintenance. Liquid nitrogen stocks were also prepared and stored within the first two weeks after the establishment of mutant strains.

Confirming the Presence of *E. canis* or *A. phagocytophilum* Mutants.

The cultures of *E. canis* or *A. phagocytophilum* which grow well in the presence of antibiotics are screened for allelic exchange mutation positives by genomic DNA analysis by insertion specific PCRs. The protocols are the same as we described for *E. chaffeensis*.

RNA Analysis by RT-PCR to Verify the Loss and Restoration of Transcription.

Total RNAs from wild type and mutant *E. canis* or *A. phagocytophilum* organisms grown in ISE6 cell cultures are isolated by following the TRI-reagent total RNA isolation method and treated with RQ1 DNase. Pathogen gene specific primers are used in RT-PCR analysis and the presence of specific amplicons is assessed by agarose gel analysis and by subjecting the products to DNA sequence analysis (Sambrook, J. & Russell, D. W. Molecular cloning: a laboratory manual. Cold Spring Harbor Laboratory, Cold Spring Harbor, N.Y. (2001)).

Example 3

Materials and Methods

In Vitro Cultivation and Cell-Free *E. chaffeensis* Recovery

*E. chaffeensis* Arkansas isolate wildtype and the mutants were grown in the canine macrophage cell line, DH82. Isolation and purification of cell-free *E. chaffeensis* wildtype and its mutants were carried out as follows. Briefly, the bacterial infection rate in DH82 cells was assessed with Diff-Quik staining. After 72 h of infection when the infection reached to about 80-90%, the culture from four T-150 confluent flasks was harvested and centrifuged at 500×g for 5 min. Cellular pellets were resuspended in 1×phosphate buffered saline (PBS) containing protease inhibitors (Roche, Indianapolis, Ind.) and cells were homogenized on ice by passing through, 15-20 strokes with a 23 g needle in a 10 mL syringe. Efficiency of homogenization, 80-90% lysis, was checked under light microscope. Whole cell lysate was centrifuged at 500×g for 5 min at 4° C. The resulting supernatant containing cell-free *Ehrlichia* organisms was filtered through a 2 μm sterile membrane filter (Millipore, Billerica, Mass.). Cell-free *Ehrlichia* from filtrates were pelleted by centrifuging at 15,000×g for 15 min and the pellet was suspended in PBS and then layered onto 30% diatrizoate meglumine and sodium solution (Renografin) MD-76R (Mallinckrodt Inc, St. Louis, Mo.). The suspension was centrifuged for 1 h at 100,000×g at 4° C. in a S50-ST swinging bucket rotor (Beckman, Indianapolis, Ind.). The pellet of cell-free *Ehrlichia* were washed at 15,000×g for 15 min and used for experiments.

Bacterial mRNA Enrichment and Sequencing

Bacteria mRNA enrichment and cDNA library preparation and RNA sequencing were performed as follows: Briefly, RNA from wildtype and mutants were isolated from purified cell-free *Ehrlichia* using TRIzol Reagent (Sigma-Aldrich, St. Louis, Mo.). RNA samples were then treated with DNase I (Invitrogen, Carlsbad, Calif.) and bacterial RNA was enriched by removing host 18 S rRNA, 28 S rRNA, and polyadenylated mRNA using MICROBEnrich Kit (Ambion, Foster City, Calif.). The quantity and integrity of bacterial RNA before and after enrichment was assessed using a NanoDrop 2000 spectrophotometer (Thermo Scientific, Waltham, Mass.) and Agilent 2100 Bioanalyzer (Agilent Technologies, Santa Clara, Calif.). The Ribo-Zero Magnetic Kit was used to isolate mRNA from total RNA samples and then fragmented into short fragments as per the manufacturer's protocols (Epicentre, Madison, Wis.). Subsequently, cDNA was synthesized using the mRNA fragments as templates. Libraries of cDNAs for wildtype and mutants were prepared using the TruSeq RNA Sample Prep Kit (Illumina, Ingolstadt, Germany). Sample libraries were quantified using Agilent 2100 Bioanaylzer and library quality was assessed by Real-Time PCR (ABI StepOnePlus) prior to subjecting the samples to sequencing on Illumina HiSeq™ 4000 (Beijing Genomics Institute (BGI), Philadelphia, Pa.).

Bioinformatics Analysis

The original image data were transferred into raw sequence data via base calling. Raw reads were subjected to quality assessment to determine whether the raw reads were qualified for mapping. The bases with low quality (<20) were excluded from the analysis. Raw reads were then filtered to remove adapter sequences and low quality reads, then clean reads were aligned to the *E. chaffeensis* Arkansas strain complete genome as per the first annotated GenBank #CP000236.1 using SOAPaligner/SOAP2. This accession number was selected and used because our prior publications, and similarly other investigators, widely used it for referring to gene names and numbers listed in it. Not more than five mismatches were allowed in the alignment, which is a standard cut off used for the alignment analysis. The alignment data were used to calculate distribution of reads on reference genes and determine the gene coverage. Alignment results were assessed for quality check and then proceed with analysis of DGE. The gene expression level was calculated using RPKM method of normalizing for total read length and the number of sequencing reads. We used p-value<0.05, False Discovery Rate (FDR)≤0.001, and the absolute value of Log 2 Ratio≥1 as the threshold to judge the significance difference in gene expression. The FDR uses accurate p-values as a measure of control in multiple sample comparison of RNA seq data. Corrections for false positive and false negative errors were performed using the method described by Benjamini and Yekutieli.

Quantitative Real-Time Reverse Transcription PCR

SYBR green detection-based quantitative real-time reverse transcription PCR (qRT-PCR assays were performed to validate the gene expression changes observed in the RNA seq data analysis). Wildtype, ECH_0379, ECH_0490, and ECH_0660 mutants' RNAs used in generating the RNA seq data were also used to determine transcript levels by performing quantitative RT-PCR by SYBR Green assays using a SUPERSCRIPT® III Platinum SYBR Green One-Step qRT-PCR Kit (Invitrogen, Carlsbad, Calif.). RNA was reverse transcribed from all the replicates using SuperScript III and then quantitative-PCRs were performed in a 25 µL reaction containing 0.5 µM each of forward and reverse primers. Thermal cycler conditions were; 94° C. for 15 sec, 60° C. for 30 sec, and 74° C. for 15 sec for 40 cycles. Thirteen randomly selected differentially transcribed genes were used in validation experiments using StepOnePlus™ Real-Time PCR instrument (Applied Biosystems, Foster City, Calif.) and the data were analyzed by StepOne Software v2.3. *E. chaffeensis* 16 S rRNA was quantitated by real-time RT-PCR and used for normalization of RNA concentrations among different RNA batches, prior to performing the validation experiments. For qRT-PCR data, the delta-delta Ct (ΔΔCt) calculation was employed to calculate relative change in the expression and fold change was obtained by averaging the replicate values of gene expression and the standard error. Semi-quantitative one-step RT-PCR (Life Technologies, Carlsbad, Calif.) targeting to *E. chaffeensis* genes ECH_0490 and ECH_0492 near the transposon mutation downstream to ECH_0490 gene was performed with 30 cycles of amplification using the gene specific primers as described in a previous study (*PLoS One;* 10, e0132657 (2015)). Briefly, RNA from wildtype and ECH_0490 mutant were used as the templates for RT-PCR. One tube without reverse transcriptase or template RNA was used as negative control. One tube with DNA as the template was used as positive control. Thermal cycler conditions were as follows: 50° C. for 1 h for reverse transcription step then followed by 35 cycles of 94° C. for 30 sec, 55° C. for 30 sec, and 72° C. for 30 sec; finally a 2-min 72° C. extension step was part of the reaction.

The rickettsial pathogen *Ehrlichia chaffeensis* causes a tick-borne disease, human monocytic ehrlichiosis. Mutations within certain genomic locations of the pathogen aid in understanding the pathogenesis and in developing attenuated vaccines. Our previ Results Isolation and Purification of Cell-Free *E. chaffeensis* from Host Cells The major challenge of undertaking transcriptome studies of intracellular pathogens is the difficulty in isolating host-cell free bacteria and subsequently recovering high-quality bacterial RNA. Rickettsial organisms, including *E. chaffeensis*, constitute only a very small fraction of isolated total RNA. Because of the presence of highly abundant host cell RNA, recovery of bacterial RNA is a challenge for executing RNA seq analysis experiments. In this study, we first purified the host cell-free bacteria from infected host cells (canine macrophage cell line, DH82) by employing an efficient cell lysis method, coupled with density gradient centrifugation protocols. Host cell lysis was performed to efficiently rupture the host cells without causing a major damage to the bacteria. *E. chaffeensis* organisms are about 0.5 to 1 μm in diameter. Therefore, infected host cell lysate was filtered through 2 μm membrane to remove most of the host cell debris. A high-speed Renografin density gradient centrifugation of the resulting *E. chaffeensis* cell suspension aided in pelleting bacteria while host cell debris remained at the top layer of the solution. After total RNA isolation and DNase treatment, Bioanalyzer analysis revealed that despite the prior fractionation of host cell-free bacteria, the host 28 S and 18 S RNA remained at high concentrations in the recovered RNA. Bacterial mRNA enrichment was carried out by depleting the host poly(A) RNA and eukaryotic ribosomal RNA using a bacterial RNA enrichment protocol, resulting in nearly undetectable levels of host 28 S and 18 S RNA. The absence of contaminating *E. chaffeensis* genomic DNA in the purified RNA samples was confirmed by real-time quantitative PCR using *E. chaffeensis* 16 S rRNA gene primers. We also confirmed the absence of DNA sequences in the RNA seq raw data by aligning 20 randomly selected *E. chaffeensis* intergenic non-coding DNA sequences (data not shown).

Ubiquitous Transcription of Genes in *E. chaffeensis* Mutants

Illumina HiSeq. 4000 RNA seq of *E. chaffeensis* wildtype and mutants generated between 75-130 million reads. The transcriptome data were deposited in the NCBI Bio-Project ID:PRJNA428837 and SRA accession:SRP128532 (found on the web at the ncbi.nlm.nih.gov/sra/SRP128532 site). Despite efficient depletion of host ribosomal RNA, only a fraction (less than 19%) of reads were mapped to *E. chaffeensis* genomes. Mapping of reads (10 reads minimum/gene) identified about 66-80% of the genes being expressed from the *Ehrlichia* genome as per the annotated genome (GenBank #CP000236.1); the transcriptome of wildtype organisms (n=3) contained transcripts for about 920 genes of the total of 1158 genes, and similarly 888, 895, and 768 gene transcripts (n=3) were identified in mutant organisms ECH_0660, ECH_0379, and ECH_0490, respectively (Table 3). The replicate RNA seq data of wildtype ($R^2$=0.9) and mutants ECH_0379 ($R^2$=0.93), ECH_0490 ($R^2$=0.68) and ECH_0660 ($R^2$=0.89) showed a high degree of expression correlation. The scatter plot expression data of wildtype vs. ECH_0379 ($R^2$=0.18) and wildtype vs. ECH_0490 ($R^2$=0.38) showed a negative correlation. Notably, the expression plot of wildtype vs. ECH_0660 showed a positive correlation ($R^2$=0.96). Only transcripts with reads per kilobase transcriptome per million mapped reads (RPKM) ≥1 were considered for differential expression analysis.

TABLE 3

| | No. of genes identified (>3 RPKM, 10 reads minimum) | | | |
|---|---|---|---|---|
| | Replicate 1 | Replicate 2 | Replicate 3 | Avg (std dev) |
| Wildtype | 888 | 900 | 973 | 920 (46) |
| ECH_0379 | 920 | 882 | 883 | 895 (21) |
| ECH_0490 | 841 | 670 | 793 | 768 (88) |
| ECH_0660 | 780 | 917 | 969 | 888 (97) |

Global Transcriptome of *E. chaffeensis*

Distribution of the transcripts in wildtype *E. chaffeensis* included 481 transcripts represented by less than five transcripts, followed by hypothetical protein transcripts (178) representing 19% of transcriptome, and 127 ribosomal protein gene transcripts (14%). Transcripts of major outer membrane proteins (22 transcripts) represent the next most abundant group. Conserved domain protein transcripts encoded from 14 genes are associated with NADH dehydrogenase I complex. Other highly expressed genes included molecular chaperones, ATP synthase, putative membrane protein, cytochrome c oxidase, GTP-binding protein, putative lipoprotein, translation elongation factor, ABC transporter, and DNA polymerases; all of which represented 0.5-1.7% of the transcriptome.

ECH_0379 mutation caused transcriptional down-regulation of many genes involved in antiporter activity, phage proteins, and those involved in transport and transcription function.

Differential gene expression (DGE) was determined by comparing the RPKM expression values of mutants and wildtype. Fold changes were considered significant with a p-value<0.05, False Discovery Rate (FDR)≤0.001, and consistency of expression values between replicates. The change in gene expression was not significant between wildtype and mutants for housekeeping genes. Based on these criteria, 41 genes were identified as predominantly downregulated and two genes were upregulated in the ECH_0379 gene mutant compared to wildtype (Table 4). The most prominent genes that showed a significant decrease in the transcription levels were those encoding for antiporter proteins, ABC transporters, and ATP-dependent Clp protease (ECH_0367). Four antiporter protein genes: monovalent cation/proton antiporter (ECH_0466), Na(+)/H(+) antiporter subunit C (mrpC) (ECH_0469), potassium uptake protein TrkH (ECH_1093), and nitrogen regulation protein NtrY (ECH_0299) showed a significant decline in the transcript levels. In addition, transcripts for two membrane transporters: cation ABC transporter permease protein transcript of the gene ECH_0517 and another ABC transporter permease protein transcript of the gene ECH_0972 were downregulated. Three genes coding for phage-like proteins {phage prohead protease (ECH_0032), phage portal protein (ECH_0033), and phage major capsid protein (ECH_0830)} were also downregulated in the mutant strain. Transcripts for 6 genes involved in transcription, namely DNA replication and repair protein RecF (ECH_0076), formamidopyrimidine-DNA glycosylase (ECH_0602), dimethyladenosine transferase (ECH_0648), GTP-binding protein EngA (ECH_0504), leucyl-tRNA synthetase (ECH_0794), and endonuclease III (ECH_0857) were also downregulated in this mutant strain. The enzymes of metabolic processes such as glutamate cysteine ligase (GCL) (ECH_0125), DNA/pantothenate metabolism flavoprotein (PMF) (ECH_0374), ATPase, AGF1 (ECH_0392), uroporphyrinogen III synthase (UPGS) (ECH_0480), diaminopimelate decarboxylase (DAPDC) (ECH_0485), biotin-acetyl-CoA-carboxylase ligase (BACL) (ECH_0848), and argininosuccinate lyase (ASL) (ECH_0937) are also down-regulated. Transcripts for 8 hypothetical protein genes; ECH_0021, ECH_0161, ECH_0264, ECH_0289, ECH_0725, ECH_0879, ECH_0913, and ECH_1053 were also among the downregulated genes in this mutant.

TABLE 4

| Gene ID | Wildtype gene expression (RPKM) | ECH_0379 gene expression (RPKM) | Fold change (ECH_0379/Wildtype) FDR ≤0.001, p-value <0.05 | Gene name |
|---|---|---|---|---|
| Down regulated genes | | | | |
| ECH_0021 | 391 | 211 | −1.88 | conserved hypothetical protein |
| ECH_0032 | 82 | 26 | −3.2 | phage prohead protease, HK97 family |
| ECH_0033 | 41 | 20 | −1.53 | phage portal protein, HK97 family |
| ECH_0076 | 287 | 59 | −5 | putative DNA replication and repair protein RecF |
| ECH_0125 | 386 | 185 | −2.08 | glutamate-cysteine ligase |
| ECH_0161 | 81 | 42 | −1.92 | hypothetical protein |
| ECH_0188 | 586 | 121 | −5 | putative surface protein |
| ECH_0264 | 814 | 194 | −4.16 | conserved hypothetical protein |
| ECH_0289 | 102 | 52 | −1.96 | hypothetical protein |
| ECH_0299 | 1432 | 442 | −1.81 | putative nitrogen regulation protein NtrY |
| ECH_0367 | 3407 | 1784 | −1.92 | ATP-dependent Clp protease, ATP-binding subunit ClpB |
| ECH_0374 | 411 | 157 | −2.63 | DNA/pantothenate metabolism flavoprotein family protein |
| ECH_0392 | 845 | 159 | −5.55 | ATPase, AFG1 family |
| ECH_0466 | 432 | 252 | −1.72 | monovalent cation/proton antiporter |
| ECH_0469 | 137 | 52 | −5.55 | Na(+)/H(+) antiporter subunit C |
| ECH_0473 | 793 | 306 | −5.55 | aromatic-rich protein family |
| ECH_0480 | 319 | 92 | −3.22 | uroporphyrinogen-III synthase |
| ECH_0485 | 537 | 172 | −3.14 | diaminopimelate decarboxylase |
| ECH_0504 | 859 | 288 | −3.03 | GTP-binding protein EngA |
| ECH_0517 | 503 | 52 | −10 | putative cation ABC transporter, permease protein |
| ECH_0523 | 1525 | 159 | −10 | conserved domain protein |
| ECH_0541 | 251 | 124 | −2 | 5-formyltetrahydrofolate cyclo-ligase family protein |
| ECH_0602 | 84 | 24 | −3.57 | formamidopyrimidine-DNA glycosylase |
| ECH_0648 | 399 | 138 | −2.94 | dimethyladenosine transferase |
| ECH_0725 | 648 | 280 | −2.32 | conserved hypothetical protein |
| ECH_0756 | 815 | 153 | −5.55 | divalent ion tolerance protein CutA1 |
| ECH_0789 | 1154 | 363 | −3.22 | cytochrome c-type biogenesis protein CcmE |
| ECH_0794 | 1593 | 306 | −5.26 | leucyl-tRNA synthetase |
| ECH_0830 | 397 | 123 | −3.22 | phage major capsid protein, HK97 family |
| ECH_0848 | 1015 | 253 | −4 | biotin—acetyl-CoA-carboxylase ligase |
| ECH_0857 | 638 | 311 | −2.04 | endonuclease III |
| ECH_0864 | 455 | 246 | −1.85 | conserved domain protein |
| ECH_0879 | 520 | 153 | −3.44 | hypothetical protein |
| ECH_0913 | 570 | 114 | −5 | conserved hypothetical protein |
| ECH_0937 | 521 | 284 | −1.85 | argininosuccinate lyase |
| ECH_0972 | 524 | 285 | −1.85 | ABC transporter, permease protein |
| ECH_0998 | 722 | 332 | −2.17 | ubiquinone/menaquinone biosynthesis methlytransferase UbiE |
| ECH_1053 | 541 | 248 | −2.22 | conserved hypothetical protein |
| ECH_1063 | 201 | 106 | −1.92 | modification methylase, HemK family |
| ECH_1081 | 310 | 78 | −4 | SURF1 family protein |
| ECH_1084 | 684 | 364 | −1.88 | AraM protein |
| ECH_1093 | 973 | 320 | −2.32 | putative potassium uptake protein TrkH |
| ECH_1101 | 1143 | 190 | −6.25 | prolipoprotein diacylglyceryl transferase |

TABLE 4-continued

| Gene ID | Wildtype gene expression (RPKM) | ECH_0379 gene expression (RPKM) | Fold change (ECH_0379/Wildtype) FDR ≤0.001, p-value <0.05 | Gene name |
|---|---|---|---|---|
| Up regulated genes | | | | |
| ECH_0684 | 1765 | 3651 | 2.06 | ankyrin repeat protein |
| ECH_0495 | 942 | 1492 | 1.58 | type IV secretion system protein VirB4 |

Differential Transcriptional Regulation of T4SS and p-28 OMP Gene Cluster Genes in Mutant ECH_0490

In the ECH_0490 mutant strain, 37 genes were significantly downregulated and 17 genes were up-regulated (Table 5). Four of the downregulated genes belonged to the T4SS are ECH_0494 (VirB3), ECH_0496 (VirB6), ECH_0498 (VirB6), and ECH_0499 (VirB6); and a type I secretion membrane fusion protein (T1SS_HlyD) (ECH_0970). Molecular chaperone genes, such as a cold shock protein (CSP) (ECH_0298) and ATP-dependent Clp protease, and a ATP-binding subunit ClpA (ClpA) were also downregulated. The transport proteins including the protein export membrane protein (SecF) (ECH_0095), preprotein translocase (SecY) (ECH_0428), potassium uptake protein (TrkH) (ECH_1093), and nitrogen regulation protein (NtrY) (ECH_0299) were also among the downregulated genes. Metabolic enzymes involved in biosynthetic processes, {tetrahydropyridine-2-carboxylate N-succinyltransferasem (dapD) (ECH_0058), quinone oxidoreductase (ECH_0385), metalloendopeptidase, (MEP) (ECH_0644), peptide deformylase (PDF) (ECH_0939), serine/threonine phosphatase (PSP) (ECH_0964), pyrophosphatase (PPi) (ECH_1014), and orotate phosphoribosyltransferase (OPRTase) (ECH_1108)}, were also down-regulated. Transcription- and translation-related genes, such as elongation factors (EF-Tu) (ECH_0515), aminoacyl-tRNA synthetases (IARS) (ECH_0538), DNA-binding protein (HU) (ECH_0804), 3'-5' exonuclease domain (ECH_1011), and DNA-binding response regulator (ECH_1012), were also downregulated.

TABLE 5

| Gene ID | Wildtype gene expression (RPKM) | ECH_0490 gene expression (RPKM) | Fold change (ECH_0490/wildtype) FDR ≤0.001, p-value <0.05 | Gene name |
|---|---|---|---|---|
| Down regulated genes | | | | |
| ECH_0058 | 1902 | 1006 | −1.88 | 2,3,4,5-tetrahydropyridine-2-carboxylate N-succinyltransferase |
| ECH_0085 | 1119 | 523 | −2.17 | ABC transporter, ATP-binding protein |
| ECH_0095 | 1921 | 990 | −1.96 | protein export membrane protein SecF |
| ECH_0264 | 814 | 310 | −5.55 | conserved hypothetical protein |
| ECH_0298 | 8295 | 3870 | −2.17 | cold shock protein, CSD family; |
| ECH_0299 | 719 | 314 | −2.17 | putative nitrogen regulation protein NtrY |
| ECH_0300 | 557 | 283 | −2 | putative ribonuclease D |
| ECH_0385 | 1659 | 663 | −2.5 | quinone oxidoreductase |
| ECH_0428 | 979 | 425 | −2.32 | preprotein translocase, SecY subunit |
| ECH_0470 | 1220 | 598 | −2 | ribonuclease, Rne/Rng family |
| ECH_0475 | 977 | 444 | −2.22 | signal recognition particle protein |
| ECH_0483 | 158 | 77 | −2.04 | primosomal protein N |
| ECH_0494 | 2326 | 1034 | −2.17 | type IV secretion system protein VirB3 |
| ECH_0496 | 1059 | 435 | −2.43 | type IV secretion system protein VirB6 |
| ECH_0498 | 1154 | 490 | −2.38 | type IV secretion system protein,VirB6 family |
| ECH_0499 | 1129 | 558 | −2 | type IV secretion system protein,VirB6 family |
| ECH_0515 | 1968 | 910 | −2.17 | translation elongation factor Ts |
| ECH_0525 | 1055 | 427 | −2.5 | conserved domain protein |
| ECH_0538 | 729 | 355 | −2.08 | isoleucyl-tRNA synthetase |
| ECH_0567 | 626 | 177 | −3.57 | ATP-dependent Clp protease, ATP-binding subunit ClpA |
| ECH_0585 | 475 | 229 | −2.08 | conserved domain protein |
| ECH_0644 | 1902 | 764 | −2.5 | putative metalloendopeptidase, glycoprotease family |
| ECH_0700 | 2670 | 1073 | −2.5 | hypothetical protein |

TABLE 5-continued

| Gene ID | Wildtype gene expression (RPKM) | ECH_0490 gene expression (RPKM) | Fold change (ECH_0490/wildtype) FDR ≤0.001, p-value <0.05 | Gene name |
|---|---|---|---|---|
| ECH_0804 | 3113 | 1292 | −2.43 | DNA-binding protein HU |
| ECH_0820 | 409 | 167 | −2.5 | conserved hypothetical protein |
| ECH_0840 | 935 | 296 | −3.22 | 2-polyprenylphenol 6-hydroxylase |
| ECH_0939 | 752 | 276 | −2.77 | putative polypeptide deformylase |
| ECH_0953 | 2914 | 1480 | −2 | ribosomal protein L7/L12 |
| ECH_0964 | 1281 | 557 | −2.32 | serine/threonine phosphoprotein phosphatase |
| ECH_0970 | 474 | 247 | −1.92 | type I secretion membrane fusion protein, HlyD family |
| ECH_1011 | 2253 | 1104 | −2.04 | 3'-5' exonuclease family protein |
| ECH_1012 | 3353 | 1605 | −2.08 | DNA-binding response regulator |
| ECH_1014 | 1661 | 536 | −3.12 | inorganic pyrophosphatase |
| ECH_1093 | 973 | 416 | −2.38 | putative potassium uptake protein TrkH |
| ECH_1108 | 1903 | 938 | −2.04 | orotate phosphoribosyltransferase |
| ECH_1139 | 545 | 285 | −1.92 | major outer membrane protein OMP-1D |
| Up-regulated genes | | | | |
| ECH_0009 | 7047 | 16828 | 2.38 | putative membrane protein |
| ECH_0039 | 316 | 931 | 2.94 | 120 kDa immunodominant surface protein |
| ECH_0166 | 42488 | 96364 | 2.26 | conserved hypothetical protein |
| ECH_0167 | 718 | 2654 | 3.70 | tryptophanyl-tRNA synthetase |
| ECH_0169 | 161 | 397 | 2.46 | riboflavin biosynthesis protein RibD |
| ECH_0230 | 991 | 4109 | 4.15 | putative membrane protein |
| ECH_0251 | 1042 | 2185 | 2.1 | hypothetical protein |
| ECH_0303 | 1018 | 2856 | 2.80 | BolA family protein |
| ECH_0367 | 849 | 1274 | 2.49 | ATP-dependent Clp protease, ATP-binding subunit ClpB |
| ECH_0450 | 1261 | 3710 | 2.94 | conserved hypothetical protein |
| ECH_0531 | 1363 | 11788 | 8.65 | hypothetical protein |
| ECH_0630 | 732 | 1688 | 2.30 | FeS cluster assembly scaffold IscU |
| ECH_0655 | 1840 | 2763 | 2.03 | RNA polymerase sigma-32 factor |
| ECH_0753 | 1932 | 4153 | 2.15 | conserved hypothetical protein |
| ECH_0818 | 374 | 1222 | 3.26 | major facilitator family transporter |
| ECH_0878 | 217 | 1126 | 5.17 | hypothetical protein |
| ECH_1121 | 1578 | 3132 | 3.1 | major outer membrane protein Omp-1N |
| ECH_1136 | 698 | 8270 | 2.37 | major outer membrane protein OMP-1B |
| ECH_1143 | 3957 | 8359 | 2.24 | major outer membrane protein P28 |
| ECH_1146 | 190 | 1100 | 6.73 | major outer membrane protein P28-2 |

Upregulated protein genes in this mutant included 7 that belonged to the transmembrane protein category. Of these, four belonged to the p-28 OMP gene cluster {ECH_1143 (OMP-p28), ECH_1146 (OMP-p28-2), ECH_1136 (OMP-1B), and ECH_1121 (OMP-1N)}. In addition, two putative membrane protein genes (ECH_0009, ECH_0230) and an immunodominant surface protein gene (ECH_0039) were upregulated. Transcripts for the heat shock proteins ATP-dependent Clp protease, ClpA (ECH_0567) and ATP-binding chaperon, ClpB (ECH_0367), and the stress response-associated RNA polymerase sigma factor (RpoH) (ECH_0655) were also upregulated. Transcripts for two genes coding for iron sulfur proteins {BolA family protein (ECH_0303) and FeS cluster assembly scaffold (IscU) (ECH_0630)} were similarly up-regulated. We observed differential expression of six hypothetical protein genes, which included ECH_0166, ECH_0251, ECH_0450, ECH_0531, ECH_0753, and ECH_0878.

Mutation in ECH_0660 gene led to minimal transcriptional alterations

While we observed drastic gene expression changes in both ECH_0379 and ECH_0490 mutants, ECH_0660 mutant transcriptome showed minimal variations compared to wildtype; we observed only five genes as notably differentially expressed in this mutant (Table 6). The genes included nitrogen regulation protein (NtrY) (ECH_0299) and the ABC transporter permease protein (ECH_0972) as down-regulated genes, whereas the heme exporter protein CcmA (ECH_0295) and chaperonin (ECH_0364) were upregulated. We also identified several commonly differentially-expressed genes in ECH_0379 and ECH_0490 (Table 7). The ribonuclease D (ECH_0300) and potassium uptake protein (ECH_1093) were commonly down regulated in ECH_0379 and ECH_0490. T4SS protein VirB4 gene was down-regulated in ECH_0490 mutant, whereas this gene was up-regulated in ECH_0379 mutant. Contrary to this, ClpB was down-regulated in ECH_0379 mutant and upregulated in ECH_0490 mutant.

TABLE 6

| Gene ID | Wildtype gene expression (RPKM) | ECH_0660 gene expression (RPKM) | Fold change (ECH_0660/Wildtype) FDR ≤0.001, p-value <0.05 | Gene name |
|---|---|---|---|---|
| Down regulated genes | | | | |
| ECH_0299 | 1432 | 720 | −2 | putative nitrogen regulation protein NtrY |
| ECH_0972 | 524 | 309 | −1.69 | ABC transporter, permease protein |
| Up regulated genes | | | | |
| ECH_0295 | 336 | 631 | 1.87 | putative heme exporter protein CcmA |
| ECH_0364 | 6801 | 12150 | 1.78 | chaperonin, 10 kDa conserved |
| ECH_1147 | 1982 | 4756 | 2.39 | hypothetical protein |

TABLE 7

| Gene ID | Wildtype gene expression (RPKM) | Mutant gene expression (RPKM) | Fold change FDR ≤0.001, p-value <0.05 | Gene name | mutants |
|---|---|---|---|---|---|
| Down regulated genes | | | | | |
| ECH_0299 | 1432 | 442 | −1.81 | putative nitrogen regulation protein NtrY | ECH_0379 ECH_0490 |
| ECH_0264 | 814 | 310 | −2.63 | conserved hypothetical protein | ECH_0379 ECH_0490 |
| ECH_0300 | 557 | 283 | −2 | putative ribonuclease D | ECH_0379 ECH_0490 |
| ECH_0864 | 279 | 193 | −1.44 | conserved domain protein | ECH_0379 ECH_0490 |
| ECH_1093 | 972 | 416 | −1.81 | putative potassium uptake protein TrkH | ECH_0379 ECH_0490 |
| ECH_0495 | 833 | 517 | −1.63 | type IV secretion system protein VirB4 | ECH_0490 |
| ECH_0367 | 3407 | 1783 | −1.92 | ATP-dependent Clp protease, ATP-binding subunit ClpB | ECH_0379 |
| ECH_0745 | 712 | 437 | −1.63 | conserved domain protein | ECH_0379 |
| Up regulated | | | | | |
| ECH_0495 | 942 | 1492 | 1.58 | type IV secretion system protein VirB4 | ECH_0379 |
| ECH_0367 | 849 | 1275 | 2.49 | ATP-dependent Clp protease, ATP-binding subunit ClpB | ECH_0490 |
| ECH_0745 | 547 | 920 | 1.68 | conserved domain protein | ECH_0490 |

Validation of RNA Seq Data by Quantitative Real-Time Reverse Transcription PCR

Quantitative real-time quantitative reverse transcriptase-PCR (qRT-PCR) analysis was carried out on thirteen randomly selected genes identified as differentially transcribed according to the RNA seq data. To generate qRT-PCR data, we first normalized RNA samples to a constitutively expressed E. chaffeensis gene coding for the 16S RNA as previously described in Cheng et al. Transcript abundance for 7 down-regulated genes in ECH_379 mutant, including ECH_0466 and mrpC, ClpB, ECH_0033, NtrY, TrkH, and ECH_0972 were validated. Similarly, 6 upregulated genes from ECH_0490 mutant strain, including four transcripts belonging to an OMP gene cluster (OMP-p28, OMP-1B, OMP-1N, OMP-p28-2) and one each from ClpB and RpoH genes were verified by qRT-PCR. Likewise, the down-regulation of transcripts for the ECH_0299 and ECH_0972 genes were confirmed in ECH_0660 mutant by qRT-PCR.

Discussion

Isolation of cell-free bacterial RNA from highly abundant host RNA is the first challenge in transcriptional profiling of intracellular pathogens. Rickettsiales require culturing in host cells and then need to be purified before extracting RNA for transcriptome evaluation experiments. To document the impact of three transposon mutations on E. chaffeensis transcription, we first developed a method for isolation and purification of host cell-free E. chaffeensis organisms, from which we isolated RNA and then subjected to next generation sequencing (NGS) analysis. To isolate cell-free E. chaffeensis, we started with an efficient host cell lysis protocol, and then filtration of whole cell lysate, followed by a renografin density gradient centrifugation. The second challenge was to obtain host cell-free RNA for transcriptome profiling. Previous studies report that bacterial RNA enrichment methods result in the enrichment of bacterial RNA reads only 3-10%. Isolation of host cell-free bacteria and the bacterial RNA purification steps implemented in our study allowed a greater enrichment of E. chaffeensis RNA. In our current studies, we were able to enrich the bacterial RNA, which helped in generating up to 19% high mapping RNA reads. Notably, deep RNA sequencing analysis aided in mapping 80% of E. chaffeensis genes expressed in infected macrophage host cells.

Among the highly expressed genes, the p28-OMP multigene cluster was dominant in the transcriptome. The E. chaffeensis p28-OMP multigene locus contains 22 tandemly arranged genes coding for the bacterial immunodominant proteins. The presence of all 22 transcripts in the RNA seq data suggest that the gene cluster is among the most abundantly expressed genes. These observations are consistent with our previous proteomic study where we reported the p28-OMP genes' expression abundance. NADH dehydrogenase I complex genes were also highly expressed in *E. chaffeensis*. NADH dehydrogenase counters the phagosomal NOX2 response to inhibit host cell apoptosis34. T4SS effector proteins in some pathogenic bacteria are considered as important in manipulating a host gene expression to undermine the host immune response. The contributions of T4SS effectors in pathogenicity are already reported for rickettsiales, including for *A. marginale, A. phagocytophilum, E. canis*, and *E. chaffeensis*. The RNA seq analysis identified several transcripts encoding for T4SS proteins, including VirB3, B4, B6, B8, B9, B10, and B11. Chaperone protein genes DnaK, DnaJ, GroE, and ClpB were also highly expressed in both wildtype and mutant strains. The presence of such proteins involved in cell homeostasis and the oxidative stress response is reported in other rickettsiales, suggesting that their gene products are also critical for the *E. chaffeensis* stress response if the pathogen proteome is similarly altered as per the transcriptome reported in the current study. Indeed, our recent study suggests that the stress response proteins are important for *E. chaffeensis*. Other highly expressed protein genes included those encoding for housekeeping ribosomal proteins involved in protein synthesis, putative membrane proteins, ABC transporter, and lipoprotein; all of which are likely important for the pathogen's protein synthesis, transport, trafficking, and effector secretion into the host cells. ATP synthase subunit, cytochrome c oxidase, DNA polymerases, GTP-binding protein and translation elongation factors involved energy metabolism, cell division, and transcriptional regulation were also among the highly expressed genes in both wildtype and mutant organisms. The extent of transcriptome coverage is higher than the previously reported for *E. chaffeensis* in ISE6 and AAE2 tick cells8. This is substantial for both the enhanced detection of intracellular pathogen transcripts and also because of the abundance of gene expressions observed. Higher coverage of the transcriptome likely resulted from deep sequencing of the RNAs by next-generation sequencing compared to microarray analysis. This global set of highly expressed genes may represent products involved in pathogenicity, replication and survival of *E. chaffeensis* in host cell environment. Four transcripts that code for ankyrin repeat proteins, which are shown to mediate protein-protein interactions, were also identified in the transcriptome. Notably, the transcriptome from the wildtype and mutant organisms contained 216 transcripts that code for hypothetical proteins with unknown function. As these were within the core transcriptome, we anticipate that they represent an important set of transcribed genes for *E. chaffeensis* replication.

Transcription from large numbers of genes in ECH_0379 mutant was found to be reduced compared to wildtype. Genes representing antiporters, ABC transporters, chaperons, metabolic enzymes, and transcription regulators are among the down-regulated genes (Table 4). We predict that the mutation in the anti-porter protein gene caused a metabolic depression. Antiporter and transport proteins play an important role in the transport of ions and solutes across the cell membranes of bacteria. Antiporters are integral membrane proteins that perform secondary transport of Na+ and/or K+ for H+ across a phospholipid membrane. The *E. chaffeensis* genome contains several genes having homology to antiporter proteins or their subunits, suggesting that they are needed for the pathogen's intraphagosomal replication and survival in a host. In particular, antiporters aid bacteria in maintaining pH, salt, and temperature conditions. We observed a significant decline in transcription of antiporter genes such as monovalent cation/H+ antiporter subunit C (ECH_0469) and ECH_0466. Disrupting the antiporter function or preventing their expression may affect the pathogen's growth in vivo. Indeed, mutation in the ECH_0379 gene resulted in the attenuated growth of the organism in both an incidental host (dog) and in the reservoir host (white-tailed deer). ABC transporters also are involved in uptake of ions and amino acids and may play an important role in a pathogen's ability to infect and survive in a host cell environment. The ECH_0379 mutant had low levels of transcriptional activity of the genes ECH_0517 and ECH_0972 encoding for ABC transporters, which function at different stages in the pathogenesis of infection. These proteins promote the survival of pathogens in the host microenvironments. The mutation possibly interferes with transport mechanisms, thereby affecting its ability to infect and survive in host cells. The mutation may have also caused alterations to the transcriptions of genes involved in physiological responses, such as regulating the pathogen's metabolic activities. We also found down-regulation of several transcripts encoding for metabolic enzymes: glutamate-cysteine ligase, DNA/pantothenate metabolism flavoprotein family protein, ATPase, uroporphyrinogen-III synthase, diaminopimelate decarboxylase, biotin-acetyl-CoA-carboxylase ligase, and argininosuccinate lyase. In general, a pathogen's survival in an intracellular environment depends on its ability to derive nutrients from the host cell. Pathogenic bacteria use metabolic pathways and virulence-associated factors that undermine the host immune system so that they can derive nutrients from their host cells. It is possible that the downregulation of the transcripts from the aforementioned genes in the ECH_0379 mutant hampers the bacterial metabolic response and its capacity to derive nutrients from the host. The mutation also caused decreased expression of genes encoding DNA replication and repair protein, formamidopyrimidine-DNA glycosylase, dimethyladenosine transferase, and leucyl-tRNA synthetase. This may have also contributed to defects in pathogen's intracellular growth and survival. Our prior studies suggest that despite the mutant's attenuated growth, it failed to offer complete protection against wildtype infection challenge. If the changes in the transcriptome correlate with changes in the proteome, variations in the mutant organisms' protein expression relative to the wildtype *E. chaffeensis* may result in an altered host response, thus making the host less effective in initiating a protective host response when exposed to the mutant organisms.

Pathogenic bacteria produce T4SS effectors to weaken the host cell gene expression and contributes to bacterial virulence. RNA seq data suggested declined expressions of various T4SS component protein gene transcripts in ECH_0490 mutant. We also observed decreased transcription of chaperone proteins and several genes involved in the transcription and translational machinery, and exonuclease and DNA-binding regulator gene transcripts in the ECH_0490 mutant strain. On the contrary, ClpB (a major stress response heat shock protein) and RpoH (stress response RNA polymerase transcriptional subunit) showed increased transcription in the mutant.

Chaperone proteins play a key role in protein disaggregation and in aiding the pathogen to overcome the likely host cell-induced stress. ClpB reactivates aggregated proteins accumulating under stress conditions and it was abundantly expressed during replication stage of *E. chaffeensis*. Preventing or reducing protein aggregation and the associated protein inactivation during the bacterial growth within a host cell may benefit the pathogen in enhancing its survival. The RNA polymerase transcription regulator, RpoH, is also important for the pathogen's continued growth as it aids in promoting the expression of stress response proteins. Consistent with the prediction, increased expression of ClpB and RpoH was observed in the current study for ECH_0490 mutant. The enhanced expression from these two important genes likely enables the mutant to grow similarly to wildtype *E. chaffeensis* in vertebrate and tick hosts, as reported in our previous studies. Outer membrane proteins perform a variety of functions such as invasion, transport, immune response, and adhesion that are vital to the survival of *Ehrlichia* species, including *E. chaffeensis* and *E. ruminantium* in a host. The ECH_0490 mutant had increased abundance of OMPs compared to wildtype organisms. We found seven transmembrane genes coding for immunodominant P28/OMP family of proteins (OMP_p28, OMP_p28-2, OMP-1B, and OMP-1N) and membrane proteins (ECH_0039, ECH_0009, and ECH_0230) to be upregulated. Significant changes in the abundance of the outer membrane proteins may be associated with overall changes in the membrane architecture, thereby altering the pathogen's susceptibility to host defense. The transcriptional changes noted in the ECH_0490 mutant may not have had any negative impact on the pathogen, as the mutant grows similar to the wildtype pathogen both in white-tailed deer (the reservoir host) and in dogs (an incidental host), and in its tick host, *Amblyomma americanum*. Transcriptional activity assessment of the genes ECH_0490 (lipoic acid synthetase) and ECH_0492 (putative phosphate ABC transporter), both of which are located up and down stream to the transposon insertion mutation, respectively, suggested that the mutation has no effect on these genes' transcription. The diverse changes in the transcriptome of the mutant, while having no impact near the mutation site, suggest that the mutation impacted global gene expression and yet did not adversely affect the pathogen's survival in vertebrate and tick hosts.

The most notable observation was the apparent minimal variation in the transcriptome of the ECH_0660 mutant compared to the wildtype *E. chaffeensis*. Importantly, mutation within ECH_0660 gene causes severe growth defects in vivo in vertebrate hosts. Further, infection with this mutant also initiates a strong host response and confers protection against wildtype pathogen infection challenge. In the current study, we observed only minor changes in the gene expression in this mutant compared to wildtype. The minor changes in gene expression included genes encoding for putative nitrogen regulation protein, ABC transporter, heme exporter protein and GroES, but the variations were significantly less compared to numerous changes described in the previous two mutants. Together, these data suggest that the mutation in ECH_0660 gene led to fewer transcriptional alterations. Assuming that the proteomes of the wild type and mutant strains of *E. chaffeensis* are similarly altered as the transcriptomes, then ECH_0660 mutant proteome may be very similar to the wildtype bacterium. The greater degree of similarity between this mutant and the wildtype may enable the vertebrate hosts to recognize this mutant as closer to wildtype organism, thus inducing a stronger host response that mimics wildtype infection. The replication defect reported earlier with this mutant may have resulted due to the loss of gene expression from fewer genes such as ECH_0659 and ECH_0660, while maintaining most of the transcriptome similar to the wildtype.

CONCLUSIONS

RNA deep sequencing studies in intracellular bacteria are still a major challenge. The RNA seq data reported here provide the first snapshot of comparative transcriptomics of *E. chaffeensis*. Sequencing of enriched bacterial RNA from wildtype and mutant strains yielded a high coverage of genes. A mutation in the ORF of ECH_0379 gene caused drastic down-regulation of genes leading to metabolic depression, which may have contributed to the mutant's attenuation in vertebrate hosts. While a mutation downstream to the protein coding sequence of ECH_0490 gene induced global changes in gene expression, up regulation of stress response regulatory genes may have helped the mutant survive in the vertebrate hosts and tick hosts. A mutation within ECH_0660 gene coding sequence resulted in few transcriptional changes, thus keeping the integrity of its transcriptome similar to wildtype. While the transcriptome data are suggestive of protein expression variations, additional experimental validation from protein analysis studies is necessary to confirm the results. Together, this study offers the first detailed description of transcriptome data for *E. chaffeensis*, suggesting that variations observed in the pathogen's ability to survive in a host and the host's ability to induce protection against the pathogen may be the result of global changes in the gene expression, which in turn may impact changes in the pathogen's proteome.

SEQUENCE LISTING (55 sequences)

SEQ ID NO: 1 - DNA, 23 bp, Ehrlichia chaffeensis
tatgggcctaagatagtattacc

SEQ ID NO: 2 - DNA, 26 bp, Ehrlichia chaffeensis
aagacacacaagaacatgacactgcc

SEQ ID NO: 3 - DNA, 69 bp, Ehrlichia chaffeensis
gatcaccaaggtagtcggcaaataactcgagtatatataatcatgtatcgattatatataactgtgtgc

SEQ ID NO: 4 - DNA, 75 bp, Ehrlichia chaffeensis
cctaattaaaaaaagtcaaaattaatagtcacatttttctcgagctgtagtaccatgtgttacttaccctctttc

SEQ ID NO: 5 - DNA, 25 bp, Ehrlichia chaffeensis
acctgctgtactgagtatgttcttg

SEQ ID NO: 6 - DNA, 26 bp, Ehrlichia chaffeensis
agacaagaacatgcttcaggtgctac

SEQ ID NO: 7 - DNA, 75 bp, Ehrlichia chaffeensis
cctaattaaaaaaagtcaaaattaatagtcacatttttctcgagtgctgcattaattctatgtaattatctttag

SEQ ID NO: 8 - DNA, 65 bp, Ehrlichia chaffeensis
gatcaccaaggtagtcggcaaataactcgagtattatgctttataaatgttctcagtctattggc

SEQ ID NO: 9 - DNA, 38 bp, Ehrlichia chaffeensis
aaaaatgtgactattaattttgactttttttaattagg

SEQ ID NO: 10 - DNA, 53 bp, Ehrlichia chaffeensis
gcgatcaccgcttccctcataaacaaatacctttaacatcattaaaccatttc

SEQ ID NO: 11 - DNA, 53 bp, Ehrlichia chaffeensis
gaaatggtttaatgatgttaaaggtatttgtttatgagggaagcggtgatcgc

SEQ ID NO: 12 - DNA, 25 bp, Ehrlichia chaffeensis
ttatttgccgactaccttggtgatc

SEQ ID NO: 13 - DNA, 51 bp, Ehrlichia chaffeensis
gataattacatagaattaatgcagcatattatgctttataaatgttctcag

SEQ ID NO: 14 - DNA, 47 bp, Ehrlichia chaffeensis
gcatgcggcgatcgttctaggagctataaatctacactttcttcaac

SEQ ID NO: 15 - DNA, 27 bp, Ehrlichia chaffeensis
ctcctagaacgatcgccgcatgctagc

SEQ ID NO: 16 - DNA, 26 bp, Ehrlichia chaffeensis
aatttaatccctatttgtataattcg

SEQ ID NO: 17 - DNA, 42 bp, Ehrlichia chaffeensis
atacaaatagggattaaattatgttaagatcatcaaatgatg

SEQ ID NO: 18 - DNA, 36 bp, Ehrlichia chaffeensis
actactagtttatgttgctgtacttggatcaatatc

SEQ ID NO: 19 - DNA, 31 bp, Ehrlichia chaffeensis
tgctgcattaattctatgtaattatctttag

SEQ ID NO: 20 - DNA, 56 bp, Ehrlichia chaffeensis
tacagcaacataaactagtagttattatgctttataaatgttctcagtctattggc

SEQ ID NO: 21 - DNA, 22 bp, Ehrlichia chaffeensis
attagtgctatggcatttggtc

SEQ ID NO: 22 - DNA, 25 bp, Ehrlichia chaffeensis
caatttacatgacatactaacaagc

SEQ ID NO: 23 - DNA, 22 bp, Ehrlichia chaffeensis
tgagtgctatgatactcaaagc

SEQ ID NO: 24 - DNA, 23 bp, Ehrlichia chaffeensis
agaatcaacaaggcctacatacc

SEQ ID NO: 25 - DNA, 20 bp, Ehrlichia chaffeensis
tccgcaggatgtttcacata

SEQ ID NO: 26 - DNA, 21 bp, Ehrlichia chaffeensis
aagcaaatgctttaggtgcat

SEQ ID NO: 27 - DNA, 21 bp, Ehrlichia chaffeensis
gttacggtgaccgtaaggctt

SEQ ID NO: 28 - DNA, 27 bp, Ehrlichia chaffeensis
cacgtagtgaacaaattcttccaactg

SEQ ID NO: 29 - DNA, 26 bp, Ehrlichia chaffeensis
tgaaaatctgatcgatagtgctgtgg

SEQ ID NO: 30 - DNA, 23 bp, Ehrlichia chaffeensis
ggttgcattccctacaaccttag

SEQ ID NO: 31 - DNA, 20 bp, Ehrlichia chaffeensis
gctttggattgtttgtctta

SEQ ID NO: 32 - DNA, 20 bp, Ehrlichia chaffeensis
tccatcccataacaaatcta

SEQ ID NO: 33 - DNA, 23 bp, Ehrlichia chaffeensis
ctaaggttgtagggaatgcaacc

SEQ ID NO: 34 - DNA, 24 bp, Ehrlichia chaffeensis
acaaggtaagtaccttgcttgctc

SEQ ID NO: 35 - DNA, 534 bp, Ehrlichia chaffeensis
atgttaagatcatcaaatgatgttacacaacaaggaagtagaccaaaaactaaattaggtggtagtagtatgggaattattagaacttgtagattaggtcctgatcaagtaaaaagtatgagagcagctttagatttatttggtagagaatttggagatgttgcaacatattctcaacatcaaccagatagtgattatttgggtaatttattaagatcaaaaacttttatagctttagcagcttttgatcaagaagcagtagttggagctttagcagcttatgtattacctagatttgaacaaccaagatcagaaatttatatatatgatttagcagtttctggtgaacatagaagacaaggaatagcaacagctttaataaatttattaaaacatgaagcaaatgctttaggtgcatatgtaatttatgttcaagctgattatggagatgatcctgcagtagctttatatactaaattaggtattagagaagaagttatgcattttgatattgatccaagtacagcaacataa

SEQ ID NO: 36 - DNA, 534 bp, Ehrlichia chaffeensis
atgttacgcagcagcaacgatgttacgcagcagggcagtcgccctaaaacaaagttaggtggctcaagtatgggcatcattcgcacatgtaggctcggccctgaccaagtcaaatccatgcgggctgctcttgatcttttcggtcgtgagttcggagacgtagccacctactcccaacatcagccggactccgattacctcgggaacttgctccgtagtaagacattcatcgcgcttgctgccttcgaccaagaagcggttgttggcgctctcgcggcttacgttctgcccaggtttgagcagccgcgtagtgagatctatatctatgatctcgcagtctccggcgagcaccggaggcagggcattgccaccgcgctcatcaatctcctcaagcatgaggccaacgcgcttggtgcttatgtgatctacgtgcaagcagattacggtgacgatcccgcagtggctctctatacaaagttgggcatacgggaagaagtgatgcactttgatatcgacccaagtaccgccacctaa

SEQ ID NO: 37 - protein, 177 aa, Ehrlichia chaffeensis
MLRSSNDVTQQGSRPKTKLGGSSMGIIRTCRLGPDQVKSMRAALDLFGREFGDVATYSQHQPDSDYLGNLLRSKTFIALAAFDQEAVVGALAAYVLPRFEQPRSEIYIYDLAVSGEHRRQGIATALINLLKHEANALGAYVIYVQADYGDDPAVALYTKLGIREEVMHFDIDPSTAT

SEQ ID NO: 38 - DNA, 1176248 bp, Ehrlichia canis
aatgacaaaaagactaggaaaaggcatttttgagttaatagggaatagcacattagaaattaacaacaacatcagtactgatacccaccttacaatgccgataaatttattaaaccctagtacatcacaaccaagaaaaacttttaatcaagaatgtcttaaggaactggcagaatctatttccaaacacggcataatacaaccaataatcatcagaaaaaatccacataaaaaaggatatgaaataatagcaggagaaagaagatggagagctagcatactagcaaaattaaaatcagtacctgtaattgtaaaagaaataagtgatagtcagtgtttagaattatcaatcatagaaaacatacaaagacaagatctaacacctatagaggaagctgaagcatactctaacctcatcaatactttttcttatacacatgaagatttagcttccattataggtaaaagccgtagtcatatcacaaatatgataagaatattatctttaccaacttctataaagtctatgataaacgataaacttatatcatttggacatgccagagctttaataaatattgaaaatccagaagcaatagcagaaaaaattatttctttaaatttaaacgtaagacaaactgaactattaattaaaaatttacaaaaaccacataagaaaaaatccaaagaaaacttaacagaactagagcaatcactatctgaaatattaaatttacaaattaaaataaacggtttaaaaaacaaaggcagtattgtgataaaatataacaatacacaacaacttaactcaatactagagaagctcaagaaagtaactcaaacatagactttcaatataacaccaaagatatgtaactttcgaatacaattactgttttttttttacgcaaaagtaattcttaaaaatcactatatataaaattgtaattgagctaattatacatagcatatattataatataaattatggtttacgtatattaatggaaaatgatttaatatgcctcggtgtgattacatcatctcacgggattagcggacatgtaaaaataaaaacttttacagaaaacccagaagattttacatcttacggaacattaactgatgggataaacacgtacgaagtagaaataatatctatcatatcacaaaacataataattgcacaaattaaaggcatagtgtcaagaaccgatgcagatttactaagaaacaaaaagttttttgtagagaaaaacaaattacctaaccctacaaatgatgatgaattctattatagcgatttaatagggctaaacgttgttttagaaaacaataatgtttatggaaacataaagaaaatccacaattttggatcatgtgatattatagaaatacgtctttctaattcaaaaaaaagcactatgttaccttttacaaaagatatattcccctatgtcaatgtcaaagaaaaatacataataataacattgccagaagttataggaaataacagtgacattcaacgttaacgttttaaccatatttccagaaatgtttccaggaacattaagccattcaataataggtagagccctaaataaaggcctttggaaccttaatgttatcgatataagatcatttgcaaaagataaacataaaactgtagatgacaggccttacggcggtggacctggaatgataatgaaagcagatgttataggctcagcaatagatgaagtattaagtaaaaacaaaaacacaaaactaatatacatgtcccccagtggaataaaattaaatcaagatatttctggacaattaacacatttttctaatataactatactatgtggtcgctttgaaggaatagataagagaattttagatttttatgattttcatgaaataagtattggagattatatattatctggtggagaagttgcttgtatggttctcatagagacttgtgtcaggcttatacctggggtagttagtaatacacaaagtatacgtgatgaaagttttaccttagactataagttagaataccctcagtacacacgtccagcaaaatggaggggattagaggtccctgatgttttactctctggaaatcataaaaagattaacctttggaaagccaatcaatcttactgtataaccaagcaaaggcgtcctgaattgactggtaccatagatggagatatatatgagtgatttgcttaaggagttcaatgaacaacaaatgaaattgttgtccaacaaagaaataccaaagtttagttcaggtgatacactaagagtaagcatgaaaatttttgatggagtaagcgaacgtttacaggtattcgagggagtatgtatcaaaagaaaaaataacgggttacactcttcattcactttaagaaaaataagttacaatgaaagtattcaattacaggtgtttttatactctcccatagtagagtctatagaggttattaaattcggtagagtacgtagagcaaagctttattatatgctcagtctatttggtaaatctgcaagaataaaagaacgtagtgataggacaaaaaagctatcctaattacaatttcatacagtatatctcaattttgtaattattatttatcacacattgaaaatttacatgtaggtgctgtttattacaagttttaaggttttacctatttgaagcttttcagttagttttctctaattgcttgtacctttaaaagggctgaacacataaattcctttcatagtaaagagtaattagtagcatatatgctaaaagtactaccacttactgtgtagttagtatttagattttggctataaaactttacttcattttatgtaacaggaaatccatagctgcacttgctgatgacatttgtactttacatctattcatatcactaaagtaatattttttacaatctctttctatatttgaagcataacctatataaaccaaacctacttgctcatcaccaactctaggaccagcaaacccagtgattgagacagacacattagcctttgaattttctaaaacaccaactgccatcaaaacagatacttctgaactcacagctccatatttactaataagatctttatcaatatttaaaaatttagccttagattcatctgaatacactacaaaactagaatctaacacttttgatgcacctgggatacaagagaatagaaaagacattaatcctgctgtacatgattcagctattactattttagaattgttttctattagtttcgagacacaagtttcagctttttttaatatttcttgttctattatcatgtaataacactatcaaattataaataaattcatataatcactacaaagcaaatcatacaataaaatttagcaacaaaataacaaaacataaatatattaagtcaaaaaatccatatactattaataatagaagtaatatcttataaatgtttactaactttacttacaacaaaaaacacagttattaagttataaaaagtgtagctcctcaaattctccatacaaaattatttaagaatagcaattgagttaaaaaatacaatgtaacacactcaaaattaagatataatagcaaaataaagttgtgactttaaagattaaatagtaacttatggttaatataatatgataaacatccactttagtaacaatttatgcaagcagtttcatcgtggaattaaaggacatgatatagtaaatgacctatttccaaaattaaaaaacgaaacaatagctgcaaaagtaaacggagaattatacgatttatcaagagaaatcatagaaaattgcacttttgaagtcataacgataaacagcgaagaaggtcttgaaattatacgtcatgatactgctcacatcatggcacaagccgtgaaagaaatgtttccagatgttcaaataactattggaccaactattaaagacggtttttattatgatttcgcaacaaatcataacttttctagtgatgacctagaaataatagaaaagaaaatgatagaaattataaataaaaatgaaagctttatacgggaagtatggtctagagaagaagctataaaattcttctcaagtataggagaagactataaggtcaaaataatatctaatattccaagtaatgagaatattactgtttataagcagggaagttttactgatttatgtcgtggaccacatgcaccttcaacaaaaacatcaagagcatttaaattaacaaaagtatctggatcttattggcaaggcaattcaaataatgaaagattacaaagaatttatggtacagcatggcgtaatgaagaagaattaaaactttacttaaataatttaatagaagcagaaaaaagagatcacagaaaaattggtagggaattagagttgtttcatattcaaaatgaagcatgcggtcaaatattttggcacacaaaagggtggactatttatcgtattatagaaaattatatacgaaaaaaactagaaaataatggatatatagaagtaaaaacccccatattgttaaacaaagaactttgggaaaaatcaggacattgggataagtttcgtgaaaacatgtttttaagtgaagcagaagataaaactttagccataaaaccaatgaattgcccatgccacatacagatctttaactcaaaaattagaagttatcgagatttaccaatacgaatggcagaatttggaacatgtcataggtatgaagcatcaggagcattacatgggttaatgagagttcgcggttttactcaagatgatgctcacattttctgtacagaaagccaaattacatctgaagctctaaagttttgtaatttactcatagaaatctacaaagattttggtttcaccgatattctagtaaaattttcagatcgtccaaagaacagagctggtagcgatgaaatatgggataaagctgaagcagcattaaagaaatcagtcgaagttgctaacttaagttatgttttaaaccctggagatggagcattctatggaccaaaattagaatttacattaaaagatgctattggcagagaatggcaatgtggaactctacaaatggatttcgtattacctgaaaggttaggtgcctactatataggtagtgatgggaaaaaacatcatccagtaatgctacaccgtgctatcttaggtacttttgaaaggttcataggaatattaattgaacatcattcaggcaaatttccaatgtggttagctcctatacaattatcaatattaactatcagtgaagattccattaactatgctaattccttgaaaataaaagccgaagaacataatataagagttgaactagatactacaaacgaaaaaataaattataagatacggaaccatatccacaagaaagtacctgtgttctggatagtaggtaaaaaagaagttgaagaaaattctgtatctatacgttatttagagtccaataagcagcacgttatgcctattgataaagcgttgaaaacattattaacttgtgctagcatctagtaaattttagtcaggagtgtaagattgaaaacaaaaaagttctctaataaaaacaagattaatgaaatgatcacagcaaaaaaagtaaagcttgttgatcaaaatagtgttatgattggagttgtagacattgaagaagccttatctagagctaaagctgtcaatttagacttagttgaaatagtacatgatgatcaatatcctttatgtaagatatttgactacagtaaatataggtacagccataagaagaaaataagcgattcaaaaaagaaacaaaaaaccatcatagtaaaagaacttaagtttaagcttaatattggagataatgactataacgtaaaattgaacatgttacgtggatttatagaaagaggtgataaagtaaaaatatcgctaagatttataggaagggaaatacttcatccagaagtcggaatggagattatagaaaggttaataagagacaccgctgatattgcaaaacctgaaaatttaccaaaaaaggaaggtaatataattaacatggtattaactgcaaaataaaatttttatataactccagagcattatagcatttttaagttgtaatgctctaacttccaagaattggtttgattattaacaatactcacagtgaagtgaagacattctaattcaagcagcgtataatagaatacaaaacatactataaactttaatcgacacaacataccaggaaaaattactatcaattatatcatggctacaataagaattaaaaaattgtaaatataaaactagttgacaatatatcaatgttattgctctggagcacagggcattattacctttaattactgcttacaaaactttcaaaaataccacatttatcatcatctttaataaaaacttcaacatctctaagattttctttcgtagaatactttatatttatttttaggttaaaatccaatatgtcatttaataagtcaggccactctataattcccactccatcatcacaaatggattctattcctaaatcatacacctcacgcaaggaattaattctatacaaatcaatgtgatatatcgtaaatttattagaatgatattcattaataatactaaaagtaggactacccacatcttcacatggagctaatgcatgaactaaaaacctaacaaaagtagttttgccaacacctaaatccccaactaaagatatactgtcgccttttttcaaacctaaagcaataaaacgtgccaatttctccaaaaatactaaatctacagaactatatttaaattgcaacacattcttcttgaaaaaaaaattacttacgttcgccttgcaaatttagcaagcttataaatatattaatgtaattaaaatataaagtagttgcacccagtatagccatcttattcacagaagaatcagtgccatcattaaacttataatacatatccttaattctttgagcatcatacgcagtcataccagtaaatacaaccaccgcaacaactgacaaggcaaaatgtaatggtccactacctaaaaacaaattaaccagtgaagctatagctatccctataacacccataaataagaaagtcccaaactgagacaaatcctttttagtaacattaccataccatgccattacaccaaacatggaagatgaaataaagaacacttttgcaatactcgctgccgtatatactagaaacacataagaaatagataccccaactaatgccgcaaagctaaagaatatcatcaatatggcttgaaagcttaaaacattcagcttatacgacattagaaaaactaatcccataggtgcaaaaacaatcacccagtgtaaaggagtattatataccatagaaataacagcaggagaagaagccacaaaaaatgctactataccagtcaaacctaaagccatagccatgtaattatatacttttactagataattcctcagtccagcgctatagtaagcaccttgctgtacattactgtaattatccataaatactccacttcagaaaaaaccactgaattatagcaaaaaaatataaaaatatcaatacaaatttatcatgaatcttgtaaaagatgtcttgtctcacaacaaatttgctcaacatcctgcatattggagttaacgctagcacctttaggtagtccattacgtacttcattagataatttatcatgttgttgtgtactcatatatagcatcagtccatacccaaaacaaaatattgccataccaacagcacgaactattaatgccattggaaacgcatccataccaagaggaccaagaactcctgtatacattgcaccacctctagtctcaaaagaaagcaacactttcccagctaaaattaaaaaagtaccaaaaaatagactagtaagaactaatgattgagcaacactgtatgtagacttaccatctttattcttatttttattacatttaatcatgtaagaacataaaaacatacctgcagctattgtgaaaagtatattccctacagtatctacaattccctgcaagttaaacgcagtatcaacaggaattttactgacatcaaaaattgctggaagtgtcaaactaaaaacagcaatcgcttgcataatagtagtacaaaatgtacctgcaagatcaaacttattcgcatgcgtctcacaaaagtttgcaaatttaatactagtaggatttacacgttcatcaaattgatcttgactgattcttttcaatttttcatttacttttcttttttccctttctaaatatagaacattgtataaacctgctataagaaaagttacacacaaaaacaaggctaaataatccataaaattagcaaaaagtgttaactgattttgcgttaaatccagaacccctgattgcatgacagcaaatgaaacaaaaactacaaagtaaagaacacttgtaaccataactattttctttctaatcagatcttgacgatccaacttcaataacatactattgtatagtttcctttgtatatcacctcgactaatgccttcatattgttcaagttgtcttctatcttcaccaaacattctaccctccacgctcacaacaagtacacacttacttttagaatcaaatgatagttctacagttatattatatcataactataaaaaaaaacaaaaccattaacttgtttactctctgataatataaatattttttaatatactaaaaaaggtataaaaatgcaaaacattattattaattattttatataaaaaaagaaaaaatatgaaaataggaataaatggattaggtcgtattggaagatgcttaataagagccatatacgaaaatgaattattatataaacacaaaatagaattatctgcattaaatggatctacatcaccagaaacacatgcacatcttattcaatatgattctgttcatggaaaatttccacataatgtaacatcagaagaaggatatataataataaatgataaaaaaatcccattatcaacagaaaaagaacctaaaagcattccttgggaaaaacataacgtagatatcgtactagaatgtacaggaaaatttaataaaaaatctttagcagaacaacatataaactctacagtaaaaaaagttttagtatcagcacccatgcaagattctgatgcaacaatcgtatatggtgtaaataatgaaatgctaaaaaaagagcacaatattatctcagctggatcatgcacaacaaactgcatagcacctattttaaaaatcatgaatgatactataggaatcaataatggatttatgacaactatacactcatacacaaatgaccaaaacttagttgataacaatcacaaagatgtaagaagggcaagagcatgcatgatgtctataattcctactacaacaggagcaacaaaaactattgatttaataataccagaattaaaaggaaaacttaatggaaccgctgtacgtgtacctacagcaaacgtatccatggtagacttagtttttaattccattaaatcaactactgctaatgaaataaacgacataataaaaaattcttcacaaaactccaaagtaataaacataacagataagaaattagtatctatagacttctgtcacagtacatatagttcaatagtagatgctgatgaaacatatgttaccaataataatctgtgtcgtatagcagcttggtatgacaatgagtgggcttttgctatgagaatgttagatatagtattactattatcagaaaatcatatttaaaaaatgtaggtaaggattgtattacttaagaaattaagattataactatctttacctataaaatacctggccacgaaaacacatttataagtacaaagcaaagcttaataacacctataacctgttataaaggtatgcaacaaaaaacatagacatatattgctcaactactaaatacttttaaatgacaagtacagaattcttacccactgtaacaatactatacactttaagtataataaatttggtattataaaaaaaaataagttttatagttacttactttttagataatttaccatggatgatatcatgtcttgtatcccaagatatacattataaaggctatcattcctcatatacgcagaacaagaaaatattctgtttacatcatccttaacagatttaatagtaggacaatcaacatgaactcctcccattttatctattaaaccattagagtcttctcctattgtcaccttaacctttgcaatatcttttaataatgcaactactactgcaggtgatatacaaactgcccctataggttttttagcattataaaactcacgcacagcatttttaaattcaggtagtatataatcattttccttatcttcatcaaataagttagaaaaattttttgctactccatagccaccaggaattactaacatatcaaactcttctactctaatttgttctatatcatatacagaacctctagctattcttgcagattcaaccaaaatgtttcttacttctcctaccgattccttctttttatgatctacaacttgtttttgatttttatttggtgcaaaacatttaaaatttacattatgcctatcaagttcaagcataactaaaacagcctctctgatctctgaaccatccatatgaccacaaccagctaaaataacagcagaatttaatgccataattaaatacccttttctggaataaatgctaattttataaaaactatttataatttacaaatttatttgagtattataatattacacaattgtatttattatcgtttacctaataaacaatgaacatattactaataggatgcggtaacttaggaagtatattattaaataaatggtcacatagtgatcaaatatcaaaagtgactgtagtacagcctagcttatcaaaaaaggatacttttaacaatataactaaggtagtctttgtaaaaagtcatgaggaagtagataaagattttatacctcaaattgtagtaattgcaataaaaccacaactggtgtctgatgttatgccaaactacagaatttatagtgaatctgcatcttttatatctttatgtgccggaattgatattaattttctaaaaacatgcttaagtcctacagcaacaataattagggtaatgcctaatattgccatgtcactaggcaaaagtgtaaacctttcttatatagaagaagaattaccacatgaaaaacaaaaagtatcaactatttttaataacacaggacttatatattggatacaaaaagaagatatctttgacaaattatctcctattactggttctggtcctgcatactttttttctcttgcagaagaattagtaaaaaatactatagctgcaggtatcaatgaagaagatgctattaaacttgtatctcaaacatttataggaagtgctaaattgctagaaacaagacaaaatactataagtcatcttatatcatctataacaagccgcggcggaataacacaagctgcactgcaggtgttaaatttacatttacctcaaacaattagttcatgtttaaaggcagccatggaaaggctattatacttaaaaggattagataaaaataaataataagtgttacgcaacacttattagtagttatttttagaaaaaataaactaaaaattttatttgatatttctttaagttaaattataatgcaaagggtaatatgagcaaagggcttgtgaagccggtcaggttaggaataaagcagccgtagcattgtttctttgggttgtattgcccattttttatgttaccattctacaatgagttttgcattaaagtatagacctagtaattttaaagatctcatagggcaagaggttttagttcgtgttctacataatgcatttcacttaaataaaataccagaatctatacttttgacaggtattagtggtgtaggaaaaactaccgctgcaaggataatatctatgtgcttaaactgtatttctggaccaacgtctgatccatgtaatacatgtcaaaattgtatatctataaaaaatttcaaccatccagatgtaatagaaatagacgcagcaagcaacacaagcatagaagatgttaaagtgattttagagaattcgcgctacatgccaattagttcaaaattcaaagtatacataatagacgaagtacatatgttatctaatagtgcatttaatgccctactgaaagtactagaagaacctgcaccttatgtaaaattcattttagcaacaacagaagtaaaaaaaatacctgtaactattatatctagatgtcagaggtttgactttcaaaggatatccacagataaacttgtagatcatctaaaagtcgtggcaaaaaaagaaaatgtatccttcgatgaagaaagtataaaattaatagcatataatgctgatggatctatacgcaatgctctatctttattggagcaagctgctatatacagtaataaaatcttatctgaaaacatcacaaaagaaatgctgggttatgttagtagacatacattactagaaataatagaaccattaattatagggaatgctacagaagctctaaataaatttgaagaagcatgtaactcgtataactctgttataattttagataatatgttgcagattatttatgaaatatgttacttctctataacaaaaaaagacaactctacatctgataacagtattataacatatataaaaaacgaaaagattttatctcctacatttctatcaaggttatggcaaatgctttttaaaggtatacaggaagtaaagtcatctagctgtataaagcaggctgcaaatatgctaatcataaggttatgttatttgtcatctttaccatctccaaaacaaataatagataagattcaaggaaaaataaacaacacatcagatattaaccgtaaagcattacttgaattgttaaaaagtaataacatgcaagacttatataaccaaatttacgaatctgagtcagaagtaaaaaattataaagatgaagcattaaatatagaaactaaccaggcattatctaaagattttcatgaggattcactaaattttttcaataattcaacaaataaaaaatgtaatgtacccattgaacaaaattttgatataaataaaagtagtaatccatgttataatcaacatcttgatccaactgtttgcaatatattacaagagttcgatggagcaaaagttataaatatagaaaacataaaaaagaacaacaataaggagtgagctatgtactctagcgatcaattatctaacttacaagagatgataaaaaagaagttttccgactttcaagaacaccaaaaatctcaaatatttgaaggttcatcacttggtggaaaagtgtctgtaaaaattagtgtatccaatatggtaagctatcaagttgttgaagtaaaattagacccatcacttctacaagaaaaagccattttaatagaagatttaattaaagcagcactgaacgatgctttaaaaaagtcatccgattacaataaaaatcttgtaggttctttattatcatttggcatataatagaaaagacatgagttataaaatagcagtagtaggtgccacaggaaatgtaggtagggttattctgaacattctggcaagcaggtcatttccagcaaaagaggttgtagcgctagcatcaaaaaagtctataggtaaaaaattaagttatggagatgaagtattagaatcccaagacttagacagttacaactttactaatacagacatagcaattttttcagctggatcttcaatatcacaacagtacgcacgaacagcagcaaataaaggatgtataattatcgacaatacttccttatttcgtatggaagatgaaataccattagtagttccagaaatcaatccagaagacatagctcaatattataaacataacattattgccaatccaaattgctctactatacaaatgcttttagctttaaatccattacataaaatatcgaaaataaagagagttgtagtatcaacgtatcaatcagtttctggtgcaggaaaatctgcaatggatgaactctattcacaaaccaagggcacgtttatgaaccaaaacattgcccctaaacaatttacaaaaagaattgcttttaactgcattccacacatagatgtttttatggaagatggttcaacaaaagaagaatggaaaatggccgtagaaacaaagaaaatattagataataatatagaagtaagtgcaacatgtgttagggttccagtatttgtatcacattctgaatcattaaacgttgaattcttatctgagatttcagaagaagaagcttatgaagcattagaaaatgctccaggagttataatccttgataggagagaagatggtggatacgcaacaccattagacagtgtacatgaagacgaagtttatgtatcaagattaagaaaagacaacacagtaaaacatggtcttaatatgtggttagtaagtgacaatttaagaaaaggtgcagcattaaatgcagtacaaatagcagaaatacttgttaatgattacctttaaaaagatatttttaaaatagcaaatattgtaacactatatgaattaccagatttatttcagcaccgcttatttttataatgcacacgagtaattcctttcttcctattaaaaaatggtctaacttgaaaaaatctttttattaacacatcaatatagatgttgaattatgtggataactagagtttactacagcatcatttacattaagacacacaagtaaagccactcttattgcaagtatatcatacaaatgtatgatcaactatttctcttattttatgattaatctataaacatgataacaattcataagcaacttatacgttaaatatgaaattcattttttaattttaaagcaagatcttctctctcccaggagaaacttccattttcatcaggtattcttccaaaatgcccataacatgatgtaatcctataaataggattaagtaatactaagtgtttacaaattccataaggagataaatctatattatcttgtataaaattttttattatatcatcatcaacaaatccagtaccaaaagtattcacataaaatgaaataggataagacacaccaatagcatatgacaactgcactaaacattgatcagccaatttcgcagaaacaacattccttgccaagtaacgagccatataagcagcagatctatctattttacttggatcttttccagaaaaagccccaccaccatgaggtacatgtcctccgtatgtatctatcataatcttacgaccagttaaaccacaatccccaactggaccacctacaacaaacctacctgcaggattaactaaaaagtcactatcagggcacatccacccttcaggcaaagactccttaacataaggataaactatgtctcttatctgactttttgacaaatcttcagaatgctgtatagaaagtacaatattagacgctctaacaggaacattatttttatacaacaatgtaatctgtgtttttgcatctggaccaagatttggtatctcacaatttttcactgcagaaataatattcttcaaaattaaatgagaataaaaaattgatgcaggcataaaagtttcagtttcatttattgcatatccatacactataccctgatcaccagcaccctgcttttcaccagaactaactccaacaacaatatctggagattgctcatgtattaaaatttcaataacaacatatttccaatggaatccatcttgttcatatcctatttcttttataacttgacgagctatacactctatatcaaatttattaatactaactccacaaatttcaccactaattattaccttatttttcgttactaaagtctctatagcggtatgtacaagtggatttaatgatatataatagtcaagtatggcatcagatatttgatcagcaactttatcaggatgtccattggaaacagattcactagttatgatgtggtcagataaacaatttttataataaaacatgttaaaaacgtaaacccaaagactcttatagtatcaaatctgaaataactaaacaatatataaataatatccactttttaatacattaatatctttcatgtcatcacactcgctaataatacattcttcattactaattcaaaaatataaataatatacagaagacaagttcactaatataaaacaacatatctcatcaatttatacccattcttcaaacttacaaaatgtagataatcctaaaaaacctataaacttgacaaatgtgttaattaaagtaccattttatatttacaatgtgcccgtagctcagctggatagagcaccagccttctaagctgtgggtcaggggttcgaatcccttcgggcacaccataaaattgacaatttttaattattaatacacttttttatacttttgcgtatttttgtatcatgaacaatagcaagtactatgacgtagttatctcaggagcagggatcaatggaatgattacagcaatagcattaagtcaactgtctatctctacagctttaatagataaaaacaaaattttactatcaataccaaaagatagagtatttgccttatcaagaagatcccaggaaatattagataagtttaacatatggaacaatataaaagagcattgtcctatattagacatcttaataaaagacgaagatagttcaatatttacacactatgaccataaatctataagcgataatcctatggggtatattgtagaaagcaaatttctatgtgatgcctttaaaaaacatataaaaaaaataaacttgtactcagaatgtacatacaaatcagtaaacattacaaatgatctagtaagaatagaactaacagacaatacaatattattaacatcattattaatatctgctgaaggtaaaaattcaaccctaagacaaatatttgatataccatctatcaatcatgattattctcaaagcagtattatttgtaatataaaacatacaaatcaccataataatctagccatagagcatttttttcatggaggaccatttgcaatattacctatgtatgatggatacaggtcttctgtggtctggacaaataaaacacaaattagtgaaatgcttatgaaactaaaaaaacaagattttatggcagagttagaaaaaaaatgtgcaccttatgtaaacgatataaaactagatagcgaaataaagtgttttccattacatttgatgtttgcaaaacatttatataagaacagatttgcattgataggtgatgcagcacattctatacatcccatagcaggtcaggggttaaatttaggaataagagacattgataaactagtaaaccatataaaatcagcaaagcaatatggtatagatataggtagcaactatgtattaaaaaatttttcctatgacagatactttgataactcatctatggcaattcttactacactcatagatggaatatttactaaaaaatcttgtacagcaaaaattgcaagaagatttggattatttattgttcaaaattcaaaaagcataaaaaattatatgataaaacatgctatgggaataggaaaatttaactaactcttgtcaattacattatcacaatcctcctttttatttttcatgcacaaaatctctacagtcattttattgattgatttttctatctccatcattgcattcctttttattctgtacatttcctcacgataatcagcttgcctaaaatcaatatcagttttatcacgaaattctaaattttctccaccataactattctttttaaacatagaacatatgtattcaaacatacatctaaaaaattcattccaattaatcttagaaatcttcaaataagcccaaaaaggtataactaatgatacacctgctttaaaaaatacagaataagttagcgaatcagagttataataacaccactttaaatacttataaatgtaaatagcaacattcttaggatctctatattcaaaagcaaatctaattccttccttcatcataataaatatgaaagaagaaaaataaagaaacactgcaaaaaacaacagatttattagaagattcttcattttccttaatataaaggaaaataacatgtacctataaaaaaacataaggttattatatgaaattactttttaaaatggctgggatggaagggttcgaacctccgaatgacggtatcaaaaaccgttgccttaccacttggcgacatcccatctataccaaaaacaactatatagtaattagtaaatcttacctcatgattaacaaagattatactgatagcacaaaaatgcaaggaaaaataaaaccattaaaaataaaagcataatatgctactttttagatttaataaatagattttattattataacttttaataagttatatatttaataaaaaaataaaccttgtataacttcatattattcttctataatagcgataattaggattggttatatttttgtgaattttcaaagtataataagaaacttacaaagttattgggaagactatggatgtacaatatttcagccatatacttctgaattaggagcagcaactcttcatccagcaacttcgatgacagctatatcaaaaaagccatcaaaactggcttatgttcaacctgttattaggccatgtgatggaagatacggtgataatccaaatcgtttatatcagcaccatcaatatcaagtattaatcaaaccttctaataccgatttacaatcagattatttaaaaagtttagaaagaataggaatatctatcaaaactcacgacataaaatttatagaagacgattgggaaaatccaagcattggtgcttggggtttaggatgggaagtaacctgtaatggtatggagataactcaatttacttatatgcaacaagtaggtggtattgaatgttctttagttccaggagaaattgcatatggcctggaaaggatagcgatgataattcaaaatgttgacaatatatataaaatattatgggatgataatggaacaacttacggagacgtattcaaacaacgcgaatatgaattttctaaactagctttagattattatgatgtagacattctatttaagcagtttaatgaagctgaacaaacatgtatttctttaatagaaaaaaaactaccattagcagcatatgatgtttgcacgaaagctagtcatatccttaatttgcttgaatctcgtggagtcattggagttaacgaacgtgcgtcttatatattacgcgtacgtaaacttgcaaatttatgttgtagcttatatactcagtgtcattaaaataagtaaaacgacatgcctttagaactattatttgaatgcttatcagaagaaacacctcctgagatgcagagtagtgcatatgcatacatggattcttatataagaaaagaactaagtcgttgtaacatcagttttgagtctgtaaaggtatttgtaacttcaaatagattaaccttgtatgtaaaaaatataatcaataacttatcaaataatacattaaagataaaaggacctaaagtatcagcagataagattgcaatagaaggttttttaaagaaagttaataaaaatttcagtgaccttataacatgcaaaatcggtaatgatgatttttactatgctgagcttaatcataatgaagaaacaaatacagaacatataatcctatcaattatagaaaacatgttaaacaactttccatgggataaaaaaatgagatggggaggtggaaaaacatattgggttcgccctatactaaatataatgtgtatacttgatggaaaagtactaccaataaagtttgcagatatagaagcaaataacaaatcatgtggtaacagattcacaaataaagaattttttgaagttgcagattttaattcttataattcaaaactaaaaaaaaataatgtaattttatgccaaaaagaaaggctcaattttatattacatcaaataaaaagtataacagaagaaagtaatttaatatgtgaggataatcaaaaattaattaataaattgaatggaactttagaatatccaatagttatcatgggatcagtggatgaaaaattctctgagttaccaaaggaattaatactaagtgtgatgcacaatcatcaaaaatacctagctgtttttaaagaagacaaaattacaaactttattacgatatctactatatcaaatgataatataataaaaggacacaataacatattaaatgccaggctattagacgcaagttttttggtaaaaaaagacaaagaatacaatattgattactacatagaaaaactcaaacaaatagtatttcatgcaaaacttggatctgtttttgaaaaagtgaaccgcataatagctttatcaaaatacatttccatatggatacctcattcctcattgataaaggtagaaagagcagcaaaattatccaagtttgatttatcaacactagctataaaagaatttccagaactacaaggaataatgggaggatattatgcctcttactttaatgaatcattagaaatttcagaatctatagttaatcactacgagccaacaaacccacaaaaagaatgtccttcttctcctatatcaatagctgtatccatatctgataaaatagataacttagttggaatgatagttgcaggagagcaagttaccagttcccgtgatcctttttccatgagaagaatggctatatcaattattagaataataatcgaaaacaatttaaacataccaataaggcttttaatagaaaaatctgtatcactgtactcatttgcaattacagaaagaactactattaacaaacttaagaatgtaatatcaagaacaaacagaaaaaaagaaattatttcatctgtaatagaatttttttcaaatagatttaaaattatcctaaaagaagacggcataaaggaagatataataaatgccgtatttgaaagcagaaaattcagtaatttattgttaataaaaacagaagctaagtttcttaacaattatatttttaccaaaaatggggttgaaataataaaggcatataaaagacttagtaatataattacaaagggagaaaacgtaaacaatacagcaaagtacaagtgtaataaaaaattattcacaataaaagaagaaactgatctatataaagaaataacttaccaaaaaaataatataaaaagattgataaaggacaacaagtttgaggaatcgttaaataatctttacaaattgagttgttgcgtaaacagttttatggacaacgtaaaagtaaatgatcaaacaaataaagaattacataaaaacaggctttctattgttaaaaatgcattttatatttttgacttagttacagattttagtaagattaaaaatacacataggtaagtcttgaatttttttaaaatcgtatataaatattttacctgatacttataaagaagaattggtatgagtaagagtgactattatgatctattaggtgtaagtaaaagtgcaacaccagaagaaataaaaaaagcttatagaaaaatggcactaaagtaccatcctgataaaaatcctggcaataaagaagcagaagaaaagtttaaagaattatcagaagcttatgatgttctcatagatcaagataagagagcagcatatgacaaatatggacacaatgcttttgatagctctggaagaggaggatttgattttaatagtggtttttctggtgatttttctgacatatttaatgatctttttggtggaggatttagaggaggaagaggatcatccagaagacatgatagcggagctgtaggatcagatttaagatttgatatagaaataacactagaggattcatttaacggtaagaaagtacctataagttatgttacttacgtaaaatgttcaagttgtagcggttctggaagtgaaggatcagcaaaatccgtacagtgtagtacatgtcatggtgtaggtaatgttagaacacaacaagggttttttacaatagaaagaacatgtcatgtatgtaatggagaaggagaaataatacaaaataaatgtaaaaaatgttctggaagtggtcgtgtaagagatgaagtaaacttacttgttacaattccaaaaggaatagaaagtggtaataaaattaggttaaatggaaaaggagaagcaggatataggggtgcaagaagtggagatttgtatgtttattctaatatacaaaaacataaattctttacacgcaatggatctgacctttattgcaatgtacccataaaaatgacacttgctgcactaggaggacatatagaaatgccatctatagatggaacatggacaaaagtgaaagtcccagaaggatcacaaaacggagataaattaagacttaaagaaaaaggaatgccaattataaattcatcaaaaagaggagatatgtacatacagataactgtagaaactcctgtgaagttaactaaaaagcaaaaagaattattacaaaagtttgatgatgaacctaacgtagattgtaatcctcagtcgactggcttttttcagaaagtaaaaagtttttggaaagatatcaggtcaaactgaaccccaataactgttaatatagagttataatatatgtcaacaaaactacttattattgttgtactctatgtcaagtcctatatctttattttgaaaagagttagttatacacccaatagaaatataatctactcctgttagtgcaatgtttctgacatttcttatgttcacacatccagaaacttctaaaactgattttccattaactatatcaaccgctttttttatttcactaatactcatattatctaacaatatcatatctacattattagacagtgattcctcaacttgagatatattgtcacattcaatagcaatatattcattttttagattttttctaagcctttgtatagctaaggtaatacttccacagctagctatatgattatcttttataagtacaccatcacacaaattgtctctataactttccccaccaccaatacatacagaatatttatctaacattcttaaaccaggagtagtttttctagtgctacgaatcttaacttttgttccagatacttcatcgacaaattgcctagtgattgacgctataccagaagcatgctgaatgaagtttaaaataactctttcaataggcagtaaatatattgctaatgcttctccacttactaaggtgctattttttcctgttatatctccatctttcttatgaatttcatactttacatgctctttattcatattaaagacttcttctagtataggaattccacaaactactaaattttctcttgtatttattgcaaaatttactttttcattaattaatatactattagtagttatatcacctttgtctcctaaatcttcttttaatgcattatgtataatttctgaaaatgagattttcatatttattacgtctttttgtacactatattataacaacattgaagtaatgtaaaaatcttatattattccaatatgaatttattacaaaataatatgaacatacatgctgttgtaatagtattatcctatttaataggatctataccatttggcttaatattatcttacattggagggctaggtgatattagaaaagtaggatcagggaatataggagcaacgaatgtttttagaaaaagcaaaaaactagctgtgatgaccttacttttagatgcagtcaaagggttaatatcagttttgttagctaaaatttatagtacggatcagacatttgcttttatatctgctatgttttctataataggacatatgtttcctgtgtggttattatttaagggtggtaaaggaatatctacacttttaggatcaatggtgcttattgaatataagtttgtaatatgctttttatttatttggattacactttttgcaatatttaagtactcttcattatcatctattgtgtcgactatttttgtagcgttgctagtgtacatgtattacacaatgaatgacacagccgtttttatagctatgtcactattaatcattacacaacatgctgacaacatagcacgaatgctaagtggaaaagaaaacaagttaaatataggattgtagtaaaatgttaaaagctttttttagagtaagcgtgacatagagcaacagctattgagtcagaaatatcataagtacctgaacatttgacattaagaatcttttctatcataaaggacacctgttctttcttggcatggccgtttcctgtaattgactttttgacatagtttgtagaatattcaaacactggtatatccttagtacttaaagttaatagtaaaatacctctagcataacatagtgatattgaagatttaggatttttatttatgaatatttcctccatagatgcactatctacctgatacaacctaaggatatcgagaacatccgtgtgtatttttcttaacctttgaccagtatcttccttactattggttactacagtacccttatctataagttttatatccttgctaacagataatatgctccatcccgtacaatttaagccagggtcaagacccattattttcatgttatgaacttatccagtacaagaaaaaaaacaataataaccatatgacatcaacaaaatgccaataccatgctgcacattcaaaacctatatggttttctggagataactgatttctttttgctctaagccaacatatagttaaaaatagtgtaccaactattacatgtactccatgaaaacctgtcatcatataaaaatttgaagaatatatggctttttccccagtttcacggaaggaaaatcctatatgtagatactctatagcctgaaatacagagaatgtaataccaagcaataaagtcatccctaacatttttactgtgtttttgttatcatcgtttatcaatgaatagtgagaccaagttaaagtacaacctgacaataagagaataactgtattcaataaaggtatagaccaagggtcaagtttagtaatgccagatggaggccaagataatagtttgctcggtactagattttcgagcatgtatacaggaaataaccaagctttaaaaaacgaccaaaagaagccaaaaaagaacattgtttctgaaagaataagggcagccatagccaacctaattcctttctttacaatttcagtatggcaattgtctctaattgcttctgtaactacgtctttccaccatttatacaagactatacttacagaagacataccaaatgcaagtacaattttgctgatatgtgatccatgaattgttccgactgctcctaacgctgttatcaatattgtgagagagaataacaatggccatgggctagggtttactagatgataatcatgtagcttccctttcattatggtatcctttaaagattatttttatttattaattttctatagtcaaagcaatagattgtcaagttcatattttacagtgttgtttttaataatgtattaaacaacagattttattgtgtctacaagtgctgcaatattagctataggggtacttggtattactccatgacctaagttaaatatgaaaggtttgtccttcattatattgattagttctttcgtttgggatattgccttacttttgtcatacgctactagatatggatctatatttccttgtagtactgacggaatgttactttttgcccaagacattggggtattatagtcgacacttgtgactgaaacttccgtttcttctgaaaactgcttgtacatcactcctgcacccttaggaaatcctatgatggggaattctggataaagtttacgtatagacgagactatttctttcgttgggtctattatccactttttgaattcgccggctggtacaattcctgcattgctatcaaaaatttgtattatgtctacaccgctttctatttgttttattaagtataaggttgtcacctttgtaattttttctactattttttctaggtttttagtttgtgaataacacatctctcttatttttgagaaatttttatctcttcctatcatataagaggctatagtccaaggtgcacctgcaaaccctatcaatggcttgtctctttgtaaggactttcttacttcttttatacccctaaaaacatttttaagatgatccaatgcagcttcttcgggaacgcttatttctgagtggttagatattagctgcaactcgggtcctttctctttcgtgaattctactttgcaacctaaggcgtcagggattaccagtatgtctgaaaatattatcgccgcgtccaagccgaacctccttactggttgtaatgtaacctcctttaccagctctggtgtataacacagttctagaaagcttcctgcctcctctgccaccttgcggtactccggtaagtatctaccggcttggcgcatgaaccagactggaatctctttttgcttggccctgcttgttatagtctttaacataaactctccattatagaaattatatatattatatccttacagatagtttttatagtttatctctgtgaattatgtgaataaaacttatttttgcaaaatatgtgagtagattttactgatgtttttttgtgaataactctgttaataaagtgtatattatactgattttctgctataatatgtgtgtataagtaatatgtgaattatgttgataactgtagttttaaccaacacctgatacgacagttattgcgaacttcatgttcctaataactctgtggataactatgtaacagaatgtggacaacttttactaacacatttcgtatcgggttattaacaaacttattaacacaaactttatatagaaaataaagttttgaatagtatacttgagtgataataaagaattacaaattgtatatgagtgataaactttctgataatagtgatagtgaagataggttatctttaaaagagtcgttaagcgctaagttagtttcatttatgatagagagaatgcctaaattaaaaagggttgtcgaaaacaatttgattgatgataacgagtgtttcaccaactcccgcatgttttataatcttagaaagttcaatgattgcttggtgagagatgtaatgattcctagaacagaaatttatgccatagacattacagatgtacctgatagcaaaaacttgatagataaggtagtgagcgggcagtacaccagaattccagcatatgagaacaatttggataacataatagggtttattcacattaaagacataatttcaaattttcataatgattttaatgtgagaaatataattcgtgaggttatgtatatccctccatctatgaaagcagtcaacttatttataaaaatgcaatcttctcacatacatgttgctgtagtagtagatgagtatggtggaacagaaggattagtgactatggcggatcttattgaagaaatagtaggtgatatagacgatgagcacgatgttcccactgttccaagtattgttaatatctctgataataaaattgaagtaaatgccagggtattagttaaaaacttggaagaaattttcaatattgattttagagattgtaaagaagatgattatgtaacaataggtggactcattttatctatgatcggtagagtacctatgacaaatgaagtttttaaacataaaagtggagctgtattttccattaaagaggctgatgataggtgtatttataaaatagttattgatttaagtgatgtaaaaaaagttgacttaaaaatcgattattgagcttaatctatctagtgtgagtttagcttttataaaagatgttgctaaatcttcatgtgtatctttaacattggtgacctttgaatatatattagcaggaaatgtgactaaactaacttcccataaggatattttctttagtacccttacacctgtttttgcatctatgtagtcatctattatactatatcctattgacaacgcattaatgataccatttttaatcattaaatacgcttctttccctttttgtaagtctagtagtaaatttgctgttatatagagtcctatattgtcttcagtcaagcttgtgatgttgcctatgggttctgtcgaattgtgttgccataatagctttattttgtgtgaattttttacagaattactaaaggcccctggtagtatgatatgcttttgtttatcaacgatgttgaacacacttgcatatcctgaaaaagtaccagattgttttatatttttttcagataaaaataaattacatgttttttgttgcataaaaaaacttctactaattatttgttaataaaattgacaatgagtgctgagatatatcatgtaatgtctaattattgaaaatttgcgaaatctcagaaatcattaaaattgtgataatatttttttatagagtatttccattctctattggtggtaacccaaaagctgctcttttttcattgatagtcatgaaagttgcattttctacgtattgccagagctgttttcttttttctgttaatacagagatggaatctttatcatatgataaaaacatattgcttccgaacctgggtattaaccaattgttaaaatgtgaaataatattgtctaagtgaggtaatattgtttgttcccatagtgaaagccttgcttcgataagattattataggtattatctccaggaataccaagcaattggggtggtacaccaaatgctaatgcaatgtcacgtgctgaactatgctttgattcgataaaatccatatctttaggggataaactcatttctttccaatctaatcccccttcaagtaatattggtcttccagcatttcttggaccagaatagaattcatctacttgtgattttaaacgagtgtattgttcttgtgttaaattaccattgttgttactttttgcgtttacaattaatgccccgcttggtctagctccattttgtagcattgcttggttccaagatccagcctggttatgttgatctatactgtatgaagctgcttctataggggataatccataataatcattaagtggatgaaagttttttatgtgtaggatttgtgaataatttgttgatttattaatcttatagtcatagtgataattatttatagaatagcgatatgaatatggcctattatcttttcctggagtaatctcaattctatctggccgcaaaagatgtaattctttgggaatcatatcatgattttctattgtcaaaatataagcattaccgctaataagtttataagtaagaattccttcgatgaattctgattttgaggtggtgttgtttggtttagatattaattttaataaaggatggttttttatttggaatgtgttgtttttgatagtcttatttagtaataaagaaacagatgctgcagctgatgcaatcatgtgaatagatctaaaagcaattacgttttttatgtagccattttctgcgaaatttgcatagcttctgtttttccatacagcctctgtaaatagttgtatgggaactgagaatgtgtaagaattgtcttgtattgacttttttttaaagaaattcattgataaaactctttgatatatataaattttattgagttgaattgatttagtaatatactaaaggtgtaaaactttgtaggtaatgtagtacaggttctatgtgagtctgtaacaagtaatatgtgtttgtcttatagctatgttagacttaatataatacatcctatgttaatagatgtggaagctgtttttatagggtgtgtatttaatttctgagctgataagtatttgtataatttgtaatgactttaatgtacgttgctattttgcctttatttatgaatattgtttttgttgttagtaattatacaatatgggtcttattactcaaaaaatacaaaaagcattcgataatgcagcaagttcgtatgataaatactctcatatacaagacgtgattttgcgtgaattatgtagcactgtggtgttagaaagttgtgataagagaaacatattagatgtagggtgtggtactggaaatatgagtaaattcttaaatgttgcaaatcataatttgattcaagtagatttatctcgggaaatgtgtgttttagctaagaaaaagaataatgcattgtcagtaaattgccatatggatgtaatgccattttatgaaaatttttttgatgttattattgcctcaatggttttacaatggtctcgtgatgttagcatttctttattggaattgtttcgagtcatgaaatctgatggtatattgtatgtggcaattccaatatttggaactctaatcgaattgaataatgtaattgaaaaagtaggaggatcttttagtcaattttataaaatgaatgaatttataaatatagtaaattcctttaatgttaaagtacaatatgcattttgttgtaattatcgtcaatatcataagtcatttcgtgctttcttattgagtatgaaattgacaggtgtatatacaaaaaaagttagtgatgaacaatataatatatttgaaataagcaagatttataaggaattatattctttgcagaattgtatttttaactcgtggaacattatgtatttggttgttaaaaagtaatttttttgtcataatgattaaatgaaagaacttgatgtcataacactattgcaagaaatacgtcatttggctcaggaaagtaatgctgtaattcttgctcattactatcaggattcagagatacaagatattgctgattttattggtgattctttagaactttccagaaaggcagccaccacaacagctgatgttattgtattttgtggtgtgtactttatggctgaagttgcgaaaataattaatcctgccaaaaaggttttattaccagatttaaatgctggatgttctttagctgattcttgtgatgcagagagttttaaaaaatttcgtgagttacataaagattgtgtatcaattacatatataaattctttagcggaggttaaagcttattctgatatcatttgtacatcttcaagtgctgaaaagataataagacaaataccagaagaaaaacaaattctatttgctccagataaatttttgggagcttttctagaaaagaaaacgaataggaaaatgattttatggcctggtacttgtatagtgcatgaaagtttttctgaacgagagttaattgatatgatggttagacatgataaagcatatgttctagctcatcctgaatgtcctgggcatttactaaaatatgctcatttcattggatcgacaactcagttattaaaattttcttctgataatcctaattcagagtttatagtgttgactgaagaaggaattattcatcaaatgaaaaaagtttcttctggaagcactttttatatagtaaaaacttcagatagtggtggatgtgtttcatgtagtaaatgcccacatatgcgtttgaatactttagaaaaattgtatttatgtttaaaaaatggttatcctgaaattacccttgatcctgaaattagtagtatggctaaaaggtctttggatgccatgcttaaaatgagttaatctttgttacgatattgttgatttattaatcttatagtcatagtgataattatttatagaatagcgatatgaatatggcctattatcttttcctggagtaatctcaattctatctggtcgcaaaagatgtaattctttgggaatcatatcatgattttctattgtcaaaatataagcattaccgctaataagtttataagtaagaattccttcgatgaattctgattttgaggtggtgttgtttggtttagatattaattttaataaaggatggtttttttatttggaatgtgttgtttttgatagtcttatttagtaataaagaaacagatgctgcagctgatgcaatcatgtgaataggatgtgcatgtgtttctggtgatgtagatagatccatttaatgcagataattctattttgtatttatataataatttacgttttttatgtagccattttctgcgaaatttgcatagcttctgtttttccatacagcctctgtaaatagttgtgtggggactgagaatatgtgagaattgtcttgtataaattcttaattactgtactgtaataaaaaatatcgtataagttgttgttcagtataaaattgtgtcatagtcacaatttagaaaaatgcagcttgatacatcatgaacatttaggtcggtatagatttgctaatagcaagtttatattacatagaaagcgtaatgctattcacttaaattttcatcaaaataaataaacttattttttgtgtacttgtgggattctgcgtctgaatatggaggtttagcagaagttatgttgttccattctttagagaattttttatttatttcataaaactttttaaggtttttctgttcttcgtttaatgcgctatcattgcattctaatacgtctcttataaaatcatctgggacgattgcatcgatgggacattctgggacacacacaccacagtctatacattgatcaggatctattactaacatattagctccttcatagaaacaatctaccgggcatacttcaacacaatcagtgtatttgcatcttatgcacctatccgttataaagtgtgtcattacagggttattaataataatgtaacggtttttattgtaatgttttttcttgccaagttcaattagtatttattattttacaaggtatagatgtggagttgtagttaaacttatacatcgtagagttaagtagtttggttaatgtttaggtaacatcctaatacgtatatgagctatcaattctatagagtatgttattttatgatagagaattgattgtggagttggatttggcaatacgtttaaaattaaaggagatttttatggatattgataatagtaacataagtacagccgatatacggagtaatactgatggcttgatagacataattatgcgtatattaggttttggtaataagaatattgtgcaaccacaggatctgggttctgaaatttatcagcaagagcaagaagatgacacagtctctcaaccttcattagagccatttgttgcagaaagtgaagtttctaaagttgaacaagaaaaaactaaccctgaggttttaataaaagatttgcaagatgttgcgagtcatgaatctggtgtatcagatcagccagctcaagttgttacagaaagagaaaatgaaattgaatcccatcaaggagaaacagaaaaagaaagtggaataactgaatctcatcagaaagaagatgaaatagtatctcaatcttcatcagagccatttgttgcagaaagtgaagtttctaaagttgaacaagaagaaactaaccctgaagttttaataaaagatttgcaagatgttgcgagtcatgaatctggtgtatcagatcagccagctcaagttgttacagagagagaaagtgaaattgaatcccatcaaggagaaacagaaaaagaaagtggaataactgaatctcatcagaaagaagatgaaatagtatctcaaccttcatcagagccatttgttgcagaaagtgaagtttctaaagttgaacaagaagaaactaaccctgaagttttaataaaagatttgcaagatgttgcgagtcatgaatctggtgtatcagatcagccagctcaagttgttacagagagagaaagtgaaattgaatcccatcaaggagaaacagaaaaagaaagtggaataactgaatctcatcagaaagaagatgaaatagtatctcaaccttcatcagagccatttgttgcagaaagtgaagtttctaaagttgaacaagaagaaactaaccctgaagttttaataaaagatttgcaagatgttgcgagtcatgaatctggtgtatcagatcagccagctcaagttgttacagagagagaaagtgaaattgaatcccatcaaggagaaacagaaaaagaaagtggaataactgaatctcatcagaaagaagatgaaatagtatctcaaccttcatcagagccatttgttgcagaaagtgaagtttctaaagttgaacaagaaaaaactaaccctgaaattctagtagaagatttgccattaggtcaagtgattccggttgttgtagagaaagatgaaatgtttgcaccttcatttaatccaatcgttataaaggaggaagataaagtttgtgaaacttgcgaacaagaatttgagattgtaaaggattcacagactgtaaaaggtagtgaagatataatatcacctatcgaatgcttagaaagtatggattctatagtttcaacaatatttgaaagtggaatgttatgtcctatgtcaaaacctggacagtatgtttgtgggtatgaaatgtatatgtatggatttcaagatgtgaaagacttattaggtggtttattaagtaatgttcctgtgtgttgtaatgttagcctttattttatggaacataattactttactaaccatgagaatattaatcacaatgtagtaaatgatattgtataattgtaaggtttagtcttgagatagcaagtgatgcttttattaagtattgcttgctatttttttgtttatttacctgctttttatatgggagaaatcatatattaagtgattgaaagtaaaagtggaattttgctgatattataggttataagcaattttttgaagtaaaaatgtatatagttagtgatatgtactaaaaagtagctgaattttattagtgagttagccattagtcttttgcctttttcagaagaactttgctgaaatgattaaaacagagtgatagttgttgttaatgtaattgataataaacggtgataggaatataagtcttcgtatatagctattcaatttagtataaaggcggaaaattggtgtgtgcataatatctaagtgtttgcttaaggtttgagttttggtaattaagaattaagtgctatcctgcgctattgtaatatgtttacgtatgtaaaagtggacaaagtagacttacctatagcgtggttgggaattaaaaataaaaagctgttctgcgctattgtaatatatttatgtatgtaaaagtatacaaagtaaacttacctatggtgcggttagtaattaagaattaagtgctatcctgcgctgtaatatgtttacgtatgtaaaagtggacaaagtagacctacctatggcgtggttgggaattaagaataaaaagctattctacgctgttataatatatttatgtatgtaaaagtgtacaaagtaaacttacctatgatgtagttgggaattaagaataaaaagctattctacgctgttataatatatttatgtatgtaaaagtatacaaagtaaacttacctatggtgtagttggtaattaagaattaaatgctattctgcgctgttataatgtatttacgtatgttaaaagtgacaaagtaaacttacctatggtgtgaattgaatgttggttaattacactttaatcacagcttgcgtcttataagaaaattactgtttatcattttttatatcttgatccttgacaggtttttcattgtgattgtcaaaatcattttcatggtgtgagttgcttatattattattttcatagtcatcatcttcattactattgttgtaatcgttgtcttcttcatcttcttcttcatcttcatcttcttcatcggtatagtcatagtcttcttcaggctgttcgctgtactcttcatcttcatctatgtactcatctaaatcatcgaagttaaaatcatcatcttcgtcttcatcatcttcataatttgtttctgtactgttatatatagcaccttcttctgttagattattttcagtgttgttaggtttgttttcaggaatatcactttcaatactagggatagggtcttcattttctttttttgttatttttacattattaggatcgtaaggttcttgagtaggtacgaaagtgcttttcaataatttttttgtaaagtttttgtcttcataatattttattttttttgattttataggataagtagactctattaaaagtatttgttcatctctaggtaacattataacttcttgaggtaataataacgctctttgtgtttctgatatgtgtaatgaacgagaggcagggtttaaatctaaaaatttaggtctatttaaagattcctgattaactgttttattgcctattagctgtgatattaggtttgcagtttcaatattgtttgctgcaaaagtaattctataagtagaatttgacagaaatgagttcattcctgcttcctcatatatacctttaagctgttcagtgtcttggataatcaaaaataatctaactctatatccacggaaatatgcaataccagtttgaaattgctccatctttcctaatgttggaaactcatccattaaaaacaatacaccgtaaggttcatcatccgatggtaaagttcgacataaaaactctgttgcttgctgatagaatacctgcattaaaggcctaagacgagttaagttgtctggtgttaatccaacatatactgttactttttttcttttaaattcttgaatattaaaatcacttgaagctgttgctgtatctattaacgggtttgcccataattctaaagatgagttcatagttgatactacacctgaacgctctttatcagctttttgtaagaatgcagctatattcatatatgcaactgggtgaatttttttccctatagtgtctaatacaactgccaagttgtagactacgtcatcactacgcattgttcgtacaacttctccaaaggattttactttttctggtactgctagtagatataatactactcctacaaataaactacgtgcttcgttgtaccaaaagtcttgttcaggcattattagattggcgattttttgtacatcatccaccatttgtcctggtttagagcttatccaatccaatggattgtaacagtgacttaccccatcaggttgagctggattccacacaaatacttcttgtcctctttttttcctccatccacttgtgagatcatagttttctaattttatgtcatgtactattacagagtcttcccaaaacaataagtttggtattacaaaacctacacctttcccagatccggttggtgcaaatagtaaagcatgttgaaatccatcagcaataagataacctcttttgtcttttcctagtagtataccttttctactacgtaatcctatttttcgaatatctttttctgttgcccatcttgaatctccatgtaatgattctttctttttaaatggtctccaatcgaatagtatgtttcttaaattccacaatactatacttaggatacctattggtatacatagtgatgatattaactttactaatagtattgcatcgtatgaagaaggattatgccaccagtgttctacgtaattaaaaacagtaggccaaattctgtctggaaagtcgctgaaactaggatttatagcgttgaaatctagatagtctggtccccataccattaagataaataaaacccctgatagataaaagcaaaattccaacccgaagaatgctcctaagaccaggaataaaatattacgtatgtggtttgcacttacactatccataaaaataacaacttaattataaaacttacgtatcatttaaccatttttctgtaaagatttagtgaataatatttctgatacataccttttaccctctgatcctctttttaactgtattacaatatctactatattagtgatgtaattaattatttgatctggaggtatgccaagtcctgcttgcataaccattaattttaattgttctagtgccatcattggtgtgtcagcgtgtaacgttgatatggaaccaggatggcctgtattaattgctcttaaaaagctaaatgcttcagatccacgtaattctcctactattatcctatctggacgcaatcttagacatgcctctattaaatcttgagtgctgactttagctctaccttgtcctccttttgaggcaattaaatggactctgtttggatgattacttaaaacaatttctcttgcatcttctactgttattagcctttcattctgaggtatacttcgtaatgctgcattggtaaaagttgtttttcctgttgatgtaccaccactaattattatgttttttttgtttattatagcatgttctagaaattgcttgatctttttttgctttaatagttcttttaattgattatctgtattattttcttgagtttctgttacagcttggttaaatgcgcccattttttcatagtcatctaatgaaagttgcattgctgatggttttctaattgacatgactactgtggttgcttcacaggctggaggaaatacgatttgtatacgatagccattaggtaaagttgctgataataatggattttcttcgcttatcttttgttctgtagcttgtgctattagtctgcctaatgcttttaaatgcgataaatttagggtcggaatggattcacaacgtatatttcctctgttttctatccatacttcacattcctggttaatagatacttcatttaccccatcttcatgaaagatggattgtagtggttcgagatacgtatctaaggcggcatagcttgttgtcatataaatcctttataattaattaacaatgtctattccacgaactgctgactttgggaacacaatgtctttattaacaaatacttttagcaaagtaccttggtctacgtatactgtaggattattattagaatatttctttattatatcttttatagagtttgaaaaatcatctactgcctgagataaaatttttacaggtaatgtagtttttgtagatttagacttatcacctgtgtcatctttctccttatcctttttttctttgctatctgactctaaaataggatagttgttaatctcagggatttttgatgtagcataggatgttgctatagatacaccagctaacagtattgttgaagttaatatattgcctatttttgtatcaacaacacctgaagctccttgtcttcctaattcatctgttccgttggagtcaagtgttatgtcaataccatgagggaggataactctattccaagatatttgaactctagtttttccggggctagcatcaaaagaataacttcctattaatctagatccttttggaatcattactgtattgctagcttcagcatagacgtctcttgctactattcctcttagtgtaccttgtaaatctgaattaatagcagtttctaagacgacatcaattatttttccttgtaaaattgttaactctaaattactcacttttgttgctactacattaggagaagatgtagtttgtaaagaaataatggaattcatcttgttaattgtagtatcaatatttgattctctctctccgttttcagaagtgccagatgctacattttgtcctcctgaaactgctaacattgatgtagctcttctttctttgtcatatcctgttgttataggtgcaataggagcagctatgtctattttattttgaacgggtaaaggtatttttggtaaaggttcaggttggggctgcggtttaggtttaatttcaacaggttgttttggtttaatttttggtattttgggtatctctagtactttaggtttttcaactgtcggaattgatggtaaagatggtgatactaaaggtggtaactccggtaattgaggtggaatgtttataggtggagatacttcttgggttggtggtacagattcttttaataatttttctatgtctgcttcttctgttgtttgtggtttgttgagactatcatctggttttttgcctgtgaagaaataataataagcaaaccctagtccaactaacatcactcctattgtgataaatttttttcctttatttactccaacaacgtttacattctcttcaatttctgtgtattggttgttttgattttcttctgacatagtgtaccatggtaagttttattataattttttattagtaatttttacagattcacttttatattctagatataagttcttatgtacaccctttattattacataattttgtaataataacattttgcaaggtacttttttctcagagttattgtatatgaaaatttgtggaataatttggttatcatttgagaacttaaaatatgtaagttttccgtcatcaaataattctacaggtagtatgttttgattttctgattttgtctctaaaatatagtgattacttgtattgttaggttttattacaacatgcttttttattttttgtactgcactaggcacagaaatgtctggcagctttacttgatttagttcgaaatcttcttcggtttttggatagtagaaacgtactatatatgttaaatctattagatcagaatagcctgcttggtcattattgtcatcactagattcatttgcactacgacatataaggtcaaaggcataacttcttcctttgtttgtttctattaacatatttgttcttccgtttttttctaatggcattatgaatagtttgttaccaactggttttactttccagcttacagtgttacccattgctaacattttgatagtttcaccttttgaaaattcaatgtacgagtggtaaccatagttaaaaactacattatagatttcattattactgtatacgaaagttttaatcctactgtctactgttacaggattatcaaccctgttgatggcatatgcactgctgttaaacatcattactaaaactaatagtagtattgtatagattttatagaaattcatcatctgccctatagtaagttatctggaatcctaaaggattaatttgccgttcttgttcattcatttcaagagttacgtattgaaatgataatgtagctattctatctttttttattatgccacttggatggttaaattctaaggagaacctgatttgtacacttcctggacgcaaatgctgtaaagatctgattttaagatatcctgatgttacatttgcatataagtttaaaggacttgcaggattacttagccttatccagttacggaactcactgtatgttgtttggttagaaaatagacgaacttttgtgtaatagttatattgaaaattattagggtcaaaaagctctctagatcttacatattctattataaaatgattatttaaaacttcgtctgctgagtattgtttgactgatacagggtttactaaagttgtgattccagattttttctctatttctactacaaatggttcaatagttctgtttttgcttatattaaaaatgacgaaaacgctgattcctactgcgcttaatgctagcatggtaaaaaacagtagcatatttctttgtataacaactgagttataacgactgacgtgccaactgtatgttgtttctaaatttgcgtttgatagtttgttattatcatttttattattcttctttctgaatttattaaacatacgtatcatcaaccttatagttttaagctatacttacaaaaataaaaatttctgttaatcagatagtcgttgcagagtgtataccttatttatttacatcagattaacgttcatatgtaaaaatagcataaaaaatacttctagcaaacgtgacctaaccttttagctttagtattgatataattaatattatgttgatttgtgtcaacaaaaataggtaatatttttgtaacttgtatgccgtgattctgaatttctgaaattttatttggattgtttgttaataattgcaatcttgaaattcccaatttctgtagtatttttatagctgggatgaataccctttcatcatcttcaaatccaaagaatctattagcatctacagtatcaaaattgtgttttatttgtagttgatatgttcttattttgttagctagccctataccacgaccatcctgggctaagtataaaattattccacctttattttctatcattaactttatggcagtatgtagttgacatcgacaatcacaagataagctgttaagtaggtcaccagtgtaacatgaagaatgaatcctaatgataggattgctataatctggattttctataataattgcgtaatgttcaagttccccagtatgtgatctgtaaacatttattttagcattggaacagtcttttagaaataaaggtgaactacatacttcctgaatttcatattctttattataattctcgattatttcttgtcttataggtgtgatgttgtttttagtacaccaatgtagtacatcagaatcattgatatcaacaacaactgctgagggtaatagttttgttaattttattagggaaatagcagttatatctaaagagtttgtacttactgtcacattatcaataacaagagatcctttgtgtaattcttgacctgttagtagggaggatatatattctagatcatgagattctttaattttgattcttgagagttggtttcctgaagattggaagatgaagtttaatctattaccggttactaatatgttgatatctttaaaatgttttttcaatgtgtttagtaattgattatctattaattcgctggggaagatgagtaagctatcattgctgttatatagcaatactgggataccacatcttagttctgcgatagacttttctgtaatatacttgttggagtgaaatctgttaaataaattttccatattatgctcaaatattacatggtgcggttgagaagactcgaacttccaaggtttttatcaaaccacagcgacctcaacgctgcgtgtctaccattccaccacaaccgcggttcatagcctttaatcctaaataaattcactgcgtgtgtcaacgtagcttgttaactataaattaataactttctttgatttttaaaagatattctataatacaatgcttattataattgagattagatttattgtaaaagaatttattatgagtatagattggtcccattactttaatattgtgaacataatacatgtgatgaactttaatatagggcatatgggaaatgttaatatgattaaataatacacgaagttgtgctaaacatgcgaaattataatactctataagtttgtataaagatggtcatgtatatcttaagctgttgaattggtgtagaagtttttttagattgtaaaatttataactaactaactgatatgtactttaatgttaaggtattatattggtgatgtattacatgtgctggttttaaacttcaattttgttagattgtgcaacaaaaagtattccttcgacttgtgatccatatattttacagtagctagaatagctacactgtaatcctgattctataatagatgattttatatacttgtctgaatggcaaaagaaatctccttcatttataaattggaaacctgatcctttctttcttcttgcaagtccgataataataccatctgtctctaacattgtttttagtaatttaagaataggatttaaactgcctgtgtactgtagtacttcagttagaatgataacgttgtattttttcttgttttggtttttcttaagaaaatcaaaaatgcttatatttattaattcattataagcttgtttaccgtttacaaaacagcctcttgctatatttatcattttgtttgatatgtcaatgcctgttatatgattacctatacttttcatttttaaaaattgaccacatataccagtaccacatccaaggtctaaaatatttaagtatgaagatttatttccaaaaaagtttattattagagacttaacatattcatgtgctttgtattgttttgctataagccaatgttctacaaaatgttcgctagtgtaatcgaaatattgctttataatgttttcaggcacatatacaatactttctggatttgttattttgtttaagtagtataaagcatctgcataattattatctaattctattgcacgtgtaaaattttgttgtgctttattgaagttttgtagtgtaaagtaacatcttccaatattataatatactactggtaatttaggtttaaagatactaataaggcgaaatctgaattttgcatcagatatatttcctttgtaaaagtggtataaaccaagatctatattagtttcaagtaagttttttagcttattttgtaatagaatggcttccttttttatggaagtgattttgttttttatagattgagaaatatcttgtggtttcggtatagttttattaatactcgatattaaagacgatacattacgctttgttatgaagaagttacttttcatatgccactcgtcaaatttttgtttaatactaatatagcataaatatgttataatgaataaacataaacatattgttaaattggtaaaataaagttttcatataactttctgtggtgttctattgattgaattattatattagttttttgtgcaagatctttatacattccgtattttttatttaattcatttttatgagatatatgttttaagaaactcaaatgcatgtgtgatattataaaatgtattatttgcgtgtctataagtcgggaaattacattattgaggaccttaaaattttttccagtgatttttgatagtaaaaatagcattaacttaatattgaaatgaatgagtatcattatatatattacacaacatagtactacactcaagcaaccaatcattacagaacgtagatagtttgattcttcgctttcttctaaggaaaaaactcctgttgcacaaagcatcttcattttatggtataataccattataggtacaaaacaaaaaaccaacagtccatttatgtttgcttcttttagtttcataaaaacccatttattactgctgacattgtagcataactatatactgtataaaagtttattggtctaagaaagtaaaatagtgacttattagacacgataaatgccattgaatatatatgataccatcccttccattaaaatagtgttatcatgttggtatgatattaataaatcaccaccttgtaaacatacgactgctgtcttgttggtgtattgacgtcttattgctgcgactaatgctgcacatgctccgctgccacatgaggctgtctccccagttccgcgttcccagaccctaagttttattttatctctggatacaatttcagcaatactaatgtttgcccttttggggaaaaggtgatgattttctagttttggtcctagtttatctagtggaattgtctctatggaatcaacaaaaaatattgcatgaggattccctacatttattcctacaggatcgcttaacatttctaattctataggtaagtgcaaagtatcacattcttgagatgtaggtatatctgtccaatggaattttgctactcctatgttgacttgtactctattttccgatgtccttaaacatgataatatacggtcagatagttcaattgttatattattatcttgtttttcattgcttaataagtatccaacacatcttgcagcatttccgcacatttcaactttgcttccatctgcattatatatgtgcataaagcaatctgctttttcagattctgttataataatgatttggtcacaaccaatacctgtttttctattggcaattgctttatagttaatgttactataagattttttcctacaatctatgattacaaaatcattagaggttccatgcatttttataaaatctatcattacaatattaagaaaaaaatggtaacgtaattattgtgatcgattttaacgagttttcaaatatttatttttgtagatagatacagtctattactgctaacagcaataaatgctatgtaaataatgtattgatcctagatatgccaacgttgttaaggctgttatatttataaaaaaatataaattactacaacagtaaataagttttacataatacttgtgtagaagtgtagatcttttttatgtaatggttctaacattttatatacttatggagttttttaataactgtactgcttctttatgttcagcaataaaactttcttctatgttttttggaagtttgatattgaaatttgagatgaaaaattgagatatgtcctgtaatcttgctacattattcttttttttgctgataaatttataagaagaaatgccttttaatatttcaatattgaggagtttatttaatagtactgattccattgttgtattaattcttaatagtatgttgctgatgatttgatcttctggtaaggatatgttgtaatctttagaatgtattgttattatgtataagcatgatatttgtaataagtgtgtttgtttatatttttgattttttattatttcccatgttattttagtggattttgtgtcatttttattattgataaatggcatatctgacatttctttaacctaagagaatcaattacgatattatagatactgatagttaaataatgtataataatggcatttgttttaatgttgatagtaaagagttatatatttgtttaataagcctataatgttgttttttatttatggtggtactgtttattataaatattttaacttgaatgattattgaatgcgtcaaatgaatgttataattgctgtagttgatcttactagaaattaaatagttctgctcaagttacaactcgtgtgtagatatttgtcaaattttattgaaaatattgcaatttttattgtagtgctagacgtaatgggttctagcattgtattttcgttaaatattttatggcattgttaaaatagagggtgcaaaggaatattatagcctttcgaatgtttgttatgtgtataatgtagttaatggtgttaatgattggcatagcgttaaagatattaatattttatttaataaattaacaagtataaaagtattaatattttttaattttttattactgatagtatagtcttggactgtatttatttatatgttaattttgccaagtaatatgatgacaaagttttgtgttactatgagaataaatttgattttataataaaaaacacttaataaattttctgtagtttataaagatatttaactattttagtgatttattaaattgttaaacaaggtaacttatatgttaaagcctcatgattttacttttcgtaatatgaaaaaaatacaagattttagttgtagtggtaaaactgtattgctgcgtgcggatttaaatgttccagtagataatgggatagttttggatgatactaggattgttagattaactacaactataaaatatttattgagtaatgatgcgaaaattgtcataatgtcgcactatggatctcctaaatcttatgataaagaattttctttaaagtttgtggttgagtatttgaataaaatatttgcaacaaatgtagtatttatagatggtgtaattggagattatgtagaacagactattcaatctgttccagcagggactatattgctgctagaaaatttgagattttacgcagaagaagaaaagaatgatttgaattttgcaaaacaacttgcgttgttggctgatatatatgttaatgatgctttttcttgtttacatcgtaagcatgcttctatagatgcgattactagagttatgccgtcttttattggctttaattttcaagaagaaatgaaatatttgagttgtgttgtttcaaatagtgagaagccagtagctgttatagttggtggttcaaaaatatcaacaaaagttcatatgttaaaaaatttgattaaaaaaatagattttttgatagtgggaggagccattgcgaataattttttgttatcacaaggtttaaaaataggtaagtcgttatacgaagagttagaaaaagatcttgtaacagaaattgtagatcttgctaagagatatgaatgtaagataattgtccctgttgattacgtagtggctaaaaattacatttgtggggatagtacaataaaagacaatgacactttagagtctgatgatatgatattagatgtaggacctcaaactgttaacatgattgctgctacgataaataaatgtagaacagtgctatggaatggtccgtgtggtatgtttgaaaaagaacctttttctaaaggaacatttagtgttgcgaacttgttgtcaaaattgactaaggtaggaaagctaaaaagtattgttggaggtggagatagtatatgtgcaataaaattatctggactttcaaatgaagactttacttatatttctacaggaggaggagctttattgcattttttgagtatcgcatgattttaaaagtaatataaagttcactttaaagtgtatgtattgtctaaatatgacagagttttattggtaatcagtttaaaatgtgttttctttaatgtagtagtttaacgaagcaatatcagtttttattcttaatatgctacagcattgagagtttctattttgttagtatttggtacatatgtatccgaaatctgtatttataaagaataatgttgattgatattagtttaattttttcaaagagctatttctgtattgtaaagcacaaaatatgtaatagatatgaatttttttatcatatgttacttagaaatggttttgtttgttgtgatttagaatatggatacattgatttgagttgtgagtagtaattgcttatggcgtattaaagagcttatattgaacagttgttaattgatttgatgttgtcagattggtatgttgacaagcaggggttataatttcttattttattatagcttctattataccatcttttagttcaattgatataatatcatttgattttagtttttttatactgctgatgtggttacggtttgtatcgtataatacagcatatcctgcttctaaagttttttctttgttaaatttattgattttattatatagcgcgtttagggattgtttcttatttaatagcagtatttttagcaatacttctattttgtttttgtattcagatagttgaagttttagtactttaatttgatgtttagttttgattaagttgttgtgtaaataaaacagcctctctttttttttatttattttatagtgtaaagttgtctttattttgttgaatttactgtttatatgttctatgagttgggtttttgttggcaaaacaatttctactgctgctgtaggtgtaggagcacgtacatctgctgcataatcaattaaagtaaagtcagtttcatgaccgattgcagaaactataggaatgctagatctagctactgcccttactattgattcatcattaaaaatccataaatcttctatactgcctcctcctctggcgataatgattacgtctggtttatttgtatcggcgttgtttagttttgatattgcatctataatttggttgatagattcattgccttgtacggatactggagatataactatgtgacttggaaagcggcttttcactctgtttagtatgtcgttaatcactgctccagtagtagatgtgattacacctgtaattttaggtagtaaaggcaaaggttttttgtttgattgatcaaaaagtccttctttttctaattttgcttttctttgttcaagcattattttcaagttgcctattccggctagcaacatgttttctgttattagctgatattttgattggtaggttgttaggaacccggagcatatgacttccaatccattttttaaatcaaattcaactttggtattgttccagcatattgcattgagtacagcagcatcatcttttaatgtgaaatatgtatgcccagattttggttgtgataaattgctgatttctcctctaacttttatatgagtaaacgtttcatgtacaaaattttggaaaattttagtgatttcactaacagtaaattctggtgtcataaaaaagctatctcaaacaagtttcctatctttatttgtatgctatcagtttcttttggtacatattgtattatatgttcaaatttataatcttctttactaggaataatatcagttttgtgtttatttaatttttctgaagaaattgcttttttttgtttattgtagaatacaaaatgtatgccgggtataaatctttcttgatcagattggttcttaatcactccttcaacttttattgcaatgctatctttgttattctttaaaatttttatttgagaatttgcgagctgtatatttgttgtgtcgtacatttctattatacggtaaatcttcctgattttatatggcatgttattttgcagcataacagaaagtgaaaatactaataatatcattgcaactattgatgatattttttttacaagaaaactactcttagtagaattattaaggatagtgttcttattgctttgtaagttgggatttgttgcatgttctttatttatgtagtccttttcaggatgatctatgttatcttgtgaggggacatgcatccacgtattattgcagtttgtgcatctaacttttttaccgctagtagggaatttactgctatctaccctataaactgcgttacaatttttgcattctatccgcattaacacaagtttgttgattatgtattataacatatatagtgtattattctcaacatgtctataatgtatgtaatttacatcatctgatattataactggggctattatggtataggttgtaatggaataaaatacttgtattttattgtccgttttgttagcatgaaattttatgaaaaactagttgtaaatatggaaaacttttgtaattttaaagacgctattgaagatgcgtggaataatttagctaatctttctagtaatacttcaattaaaaaagttgttgatgatgttatggatcttttagatcagggtaagatccgcatatgtgagaaagtaggagatcaatgggtagttaatgaatgggcgaaaaaagctatattactgtgtttccgtgtgtatgacatgaatcttgcagaaattagcagtgcagactcaatgcttggtaacttatgttggtttgataaagtgcaattgaaatttggtagatggagtgctgatgattttagagcagcaaaagttagagctgtacctgggtcaatggttcgtaagtctgcttatattgctcctaatgtagtattgatgcctagttttgtaaatgtaggtgcatatgtaggtgaaggtactatgattgatacttgggcatctgtcggaagttgtgctcaaattggtaagcattgtcatatttctggtggtgcagggataggaggtgtgttagaaccattaagttctagacctgttgtcatagaagataattgttttattggtgctcgtagtgaaattgttgaaggtgtagtagtaggtgaaggttcagtaattgctatgggtgtttatattggggcttctactagaattgttgatagagcatctggtgaaatatcttacggaaaaattcctccatattctgtagtagtgcctggttcttatggtagtggtgatttatcattatattgtgctgtgattgtcaaaaaagttgatgataaaactagaagtaaagtatctattaatgaacttttaagagatgattcttaatacataactataaatctatatatcattagtttagaatataaaaaacaaatgtactttataggtgaagtaagcgttttagctaagttgtatcgtatattttttgctaaaatatgctagtcaattacttggtaatgtgtcactcagttgaggtggttttaattgccaaaaattaagtttagtgtgaaatatggaaacttataaagagtgtatatattctaactagtgatataatagttatgatacaagttcttaatataaaaagttctctgtcttgtttttgtgagtttgttgatagttacttgaataagaaagatcaatatatagatcatcgttatatgttaacttttttgtacttaagaaagcttatgttgtttaatggaatataattttctatttaataatatagtgagttttattctaatgatgataaaattctagagtacttctactatttggaataaatgactacaatttttgctttatgtactccatggggaaggtctggagtagctgtgattagaatctctggtgaagatgctgcaaaggcatttgtgcattttggaattaatagtagtattaaaccaagaactgcaacgtttactcctttatacgacaaagatggtgaagttatagatgaagcgatagtggtgtattttgttgcaccaaatagctttactggagaagatgtagttgagtttcatactcatggtagttttgctgttattaaaatgatattagctgagcttggaaaaatttttgttcctgctgggccaggtgagttttctttgcgtgcttttttaaataataaagttgatttgactagagctgaagcaatagtagatcttataaactctgaaacagaaatgcaggctaagcaagctataagacaaatgtctggggttttggaaaagttgtatcaaaattggcgacagcagttgattgatatattatctaatatagaagcttatattgattttccggaagaagttaatagttctgctatagctaatattgattatctattaaataatttgcagaaatctttagaaagtcatcttaatgatgaccgaagaggtgaaaggttacgtcaaggtatttatgttacaattcttggtgaacctaattctggtaagtctactttatttaatcatttagcaaaaagagatattgcaattgtttctgaatatgctggtactactagagatcctctagaagcacatatagatgtagctggatatccaattattattattgatactgcaggcattagagagagtactgatccagtagaacaagaagggatcaaacgtgcgaagttaaaggctgaaaatgctgatttcaaaatagtaatgcttccttacgagaaacgagatatttttaacagagaaattatgagcttgatagatgataagtctatatgcattttaagtaaagctgataatattacagatcagaaattaatacctgtgtttgattttagttttattccgatttctgtatattgtaacattggaattgaaaatttattgaatttaattaaacaaaaagtagaaaaagattttcaattttgtaatactgacccttttattacttctgaaaggcagagaaaacatattcaaaatactttgaatattataaagtctgtagatttaagtttacctatggaaatagtgtcagaggatttaagattgtctgtaagggaattagggaaagtggtaggtgttattagtgatgatgatatattagataatgtatttggtaaattctgtataggtaaatgatatttacctggattattagtgggcatgtgtgtaagttcttggattcataattttattaataaaatacatatagtgattttttgttgtggagttattttgataagcttatttcaagttataaaagtgtaattctatggtcaaaaaatttggcaaatgtattttgcttggtaattacatatgcagcaattttattttttgtcagttttgtgaaagttttctatgaatgagactatctcctgaacttcagccattttacctgttccgtattcgttacaaattgctaacccttctttaggttcaattattgttacgttatcactttttaaacaatgaatattacgttgatttgcttttgaattccacattgcaggattcatagctgggaccatgatgataggaatgtttgaagcaattaacgcagttgtagctaattcatcagcaataccatgtgctgtttttgctattatatctaatgttgcaggcgctactagtacaatatcagaacttcgcgttaatgatatgtgatgcatacttttatgggcatgaaaaagatctgcatcagtatacacagaatttccagataatgatgctactgataatggggtaacaaacctttctccagatttgcttattatgctagtaactgtatggttattttcttgcagttttcttatcaaatctaaagatttatatgctgctatgcttcctgatattactaataaaattttcataggataaaactaggtaaacattcaatttctatcatatatttttgtatattcaaagtttaatatttataataactttgacgtattagtttaatgtaggattatagtttaatgcacaacttaagcatattttctagcatgtatatgttgccaggagttaataatgtagtagggagtttattaaaaaagttatgtggtggtgataaaattatagatttgttatttcatataccacaaagttatgtggatagaagaactgcgttatctgaagattctgtaggtaaaattgtaacttttattggtactgtgaagtgtcatggttttattggtaggaaaagaaaatcccagtataaaattgtgcttgatacatgtattggtgaagtatcattaattttttttaattactcgttgaaatatctgagaagtgttttaaaggtaggttcaacatgtgtagtaagtggtactctgataagatttttgggatgtttgcaaattacacatccggattatattgtaacagatattaaaaagttccaggatattagtatcatagaacctatttatccactaattagaggattaacttctaagagaatttcaaagttagtaaagttaagtgtaaggttgttacctgattttcctgaatggatagatgaaaaattgttaagagataatagatggaatagttggaaggaaagtttaataaaaatacatcacccagatacacttgaagctgtgcatttacatagggcaaggttagcgtatgatgaattattaagtcatcaaatctctgtaaaaatggtcaggaaatttgattaccaacaaggtgtctctattgtaagtaagcagctatactataatgatattttaaataaactgccttttaagttaacagaaggacagaaagaagtaatatctcagattacaaagagtcaagcatcagaaaataggatggtaaaactattaataggagatgtaggtagtgggaaaacagtggtagctttgtttgctattttaaatgttatagagaatggaggtcaagtagcttttatggctcctactgagatattagcagaacaacattatcgttggatacgggcgatactatctgatatttcagttgatgttgagttgttaacaagtaaggtaaggaagaaacagaatattaaaaagaaattgcaacttggtgaatgtaatgtagttattggaactcatgctttatttcaggatggtgttgattttaataatcttaatttgattatcattgatgaacaacaaagatttggagtattacagaggatgaggctaattaataaaagtaatatggctgatgtgctttttatgacagctacgcctattcctagaacattagagcaagtagtatatggggatatagattgtttaagacttaaggataagcctcacaatcgattgcctatacaaactagtattgtgaatattgagcgcttgtttgaagttatagcaaaattacaattggctttgcaagaaggtaataaggcatattggatttgtccttatattgaagattcggaattattagatatagcagcagcagaaaaacgtttttttactctacaagaagtgtttggtaaggatgtaggtttgatacacagtcgtttgcctaagattgaaaaagatgaagtcatgatgtctttttataatggaaatattaagttactagttgcaactactgtaatagaagtaggagttgatatacctgatgctactataattattatagaaaatgctgaacaatttggtctatcacagcttcatcaattacgtggtagagttggccgtagtgataaatcttctttttgtattttacttcatgggaatatgttaagtaagattgcatataaaaagctatgtatattgcgtaaatttcaagatggcttttacatagctgagcaggatttgttgttgcgtggtagtggagatgttttagggataaaacaatcaggattatcaaattttaagtttgcagatatttataaggatcaaggccttatttctattgctgttgaacaggcaggagcaattctggatgcgaataagacagaattaggtgatcattttaatcaattgttacacatgtttggttatgatgtttctactataaattattagtttttatgtgagtaagggattttgataaatttcaagtggtagtgatttttagagaagagtatatcagtttaagttttgaatagaaaattctggctataatattacaagatttagaataaaagttatgcttagatggtttctatgtaatttttagtgattcaggaatgattttgttagtagagagttatgttctcgtgaataatgttaattttattttttgtagtttttgatattattataagtacagttacaaaaattgtattagggctctgcttatataaaaagtgatcttaattttgtaggagttattttttctcaggcttttgtataaaaactatgaagttgtttctgtaattgttgttactgtgaagttgaggtattagtatgtctataaagcgtgtcgttatgtttggggggagtggttttataggtagatacttagtaaagtactttgctgagaatgggtatgtgattaggattgttactagatatccagaaaaagcaaagcaattaaagttatgtgggaatttgggtcaagtagaggttataagtggtaatgttgctaatagtgaagaagtaattgagcatatacgtgattgtaatattgttataaatttacttggtgttttatatagtgcaaagaaatctactttttatgacatacatgctaaagcagcagaaaatatagctaaagctgcaaaaaggtgtaaagtaaagttgatgattcatttttcggcaatgggaattactgaaacacaaaaatctgactatgcgaaaagtaaattgataggggaaaatcttgtgaaatctgctttccctgatgcagtgattataaggccaaacttagtttttggaccagaagataagttttttaataagtttgcacagctgtcaatgatttttccatttttgccggttataggcggtggacgtgcagttttccaacctatttatgttgatgatcttgctaagtttgtatttagtattgttgaaaattcgattacagataagctatataatgtttgtgggccttgtacttattcatttaaagagttattaagttttatcctgaacgttacaaatagaaaaagtaagcttattaatatttcttttggtgtaacaaatattttagcttttttttgtgagctgagaataatttctatttttttgaaacttattactggaactacagatccaattttaacaagagatcaggtgaaatttattaaagatatgaccgaatctcatgatatataccctatgaatgagttaaaagagattggagtaaagttgtcaactattgaaaacatagttcctaaatatttaaagatttataagagtttttagtattatagctatatgtttgcatttgatgcttattttagaaaagtttagatgtaattttttgaagatgtggagtatctctcattccttaaataggtgaaatgacggaataagttttcaattatctgaaatgtataatcctgaatattacggacttataagaagaggttggagtaaaattttcaactatgaaaacatagttccttaaatgtttaaagatttataagagtttttaatattatagctatatgtttgcatttgatgcttattttagaaaagtttagatgtaattttttgaagatgtggagtatctctcattccttaaataggtgaaatgatggaataaattttcaattatctgaaatatataaatcctgaatattgcggacttataggaagaaataggagtaaaatttttaactgttgaaaacatagttccttaaatatttaaagctttgtaagagtttttagtattatagctatatgtttgtatttgatgcttattttaaaaaagtttagatgtaattttttaaaggtgtggtagtatctctcattccttaataggtgaaatgacggaataaatttttaattacctgaaatatataatcctgaatgttacaaacttataagagttgttttattttataaatactagtttttgcttagctttcatcaatagtttgtagtccgcaacttaatgttattactatataagttacgatagtatacctatgtttaattatcatttaaaaaattattattataatcattttcttgatcattactgtaaagtttttgttgtttttctctcctttcctgttcttctatggagtataatgttattggatttgcttcaagtcttgcgatgccgatcttttctcctgtttcctcacaataaccatataatccatcatctattctttgtatagctttgtttatctctattattaatgcttcatttcttttcctagtatttaaaattagcacgatattgtgttcttttgttgccatatctgttaagtctgcatcagcttgtggacgtagtaattccgtagctagttcttcagattctttttgtagtacttctcgccatttaatcagtttttgtctgaagtattctaattgtttatgattcatgtaattgctatcatcttcatcttcaggaaatgcggtattatggttttttttcaacatttgtattccttatttgtgatacaactaaaataataatttaaatatagttgattaagaattcgtgtatgatatgtgatataatgacgatgtttttatcagttgtgggctgagtatgggcaatagtagtgcattaatgtatgaattaaagttatcgatgagtaggaaaggtaatcttttaaatgcaattattctttttatattaataattagtacagcattgtttactatgaaaaatgttgaaataataaaagtacttccaactattttatggatttgtagtatttctgctgtacatatgtctatgtgtcatttatttgaaaatgactatgctaatggctctttagagcaaatgttgatacaggaaagtatggtagagttgataatattttttaagattttatcgcattggatttgtgtaggaataccagtaagtattatttctatgtttatagattttataattctggaaagtaacatatatactactctaggattagggttgtctctaggaattagcttgctagtaattagctttatatcagctgtaggtgaagcgttagtattgggtagaggtagtggcataataatagctcagattttgacattacctattatgataccggtgttagtatattttagtcttgtatttgatagtataataaatggtgtatacagagaaaatttaatgttgcttggattaattattgctggggtagttcctattagtgtgatatttgtatcatttgcaattagagttgctgttgaatatgattagctatacgaaatattttttgatgtttgattttatatttaacaatttgaaaaatagtatgcgctaggaagattttagttacttgaattaatatgttagttaattactgttagtgtgatatttgtagttagactgtctgttgagtatgattgacttttacaatatattacttattatgttaacttgcgggtaattagctcatttggttagagcacttgcttgacgtgcaagaggtgactggttcgaatccagtattgcccactggtctgacgtaatttggttataaaatgtcgcttattcataaaaataagccttccaaccatgaaaataagctaatatatgctatttttattattatcattacgatggttgtagaagtagttggggggataatatcaaattctttggcattgctttcagatgctggacatatgtttactgattttatttctttgttattaagttggttagcatataaagttgctatgaaaaaatcagattcatgtcgttcctatggttatcatagatttcaagttgttgctgcttttattaatggactcactttgtttggtatagccattttaattatcttggagtcgataaagcgctttttttctccagaagaagtttgctgggaaattatgatgtctgttgcaatattaggattgatagcaaatgttgtatcattttttctactgtatagaaaaaatgagagtaatttgaaccttaaaagtgcagttctgcatgttgttggtgacttgttagggtcagttgcagcgattgttgcttctgttgtgattatgtttacttcatggcagatagtggatcctcttttatcagtatttgtcagtattataatacttggtggtgcatataggattattaagaattctggtcacattttacttgaaggtactccagataatatagatccggataagattagaaaaactgtttctgaaaacattgctgaagttttggatatacatcatattcatatttggtcattaactacagatcatccaattatgacaatgcatgttaaacttgataaggcagctgtaactgataatttaaagtatagtcaagtattagtatctatcaaaaaattactgagcagagattttggtattattcatgttactattgaagctgaatacgataattgtgctgatgatagtgttatgattaagacagctcataattaaattaacagtatggactgtaattaagtgactaacaattatttgataggttagtatctttattatgtttttcttgattgagatctttaaaatgttaaacggtggtaatgtcacatcgtatagcataatatgaaaaagtcaatggtattaaatgtatatttattaatttatgttatagatatagcctgtaaaatcatgagaacttgatattttatagagtattcattgtaaatggtgatgtgtattatgcattatcgttcacagtaagatgagcagcctattatatagtataagtaagtaaataaaatgattaatagttatatttgtaggttatttgttattagtttgctttttttgtttaacaatgcttttgcctatgatgctactgaagcatgtagagagcatgttaggccatgttattttattgttgcattaaaaaatcaagttgaaattactgttagagacataaaagataaagctaaaatgtatgccggtattcaatccatagttgatagggtacttaatataaaagatatttctagatttgttttaggatcgtattggaatactatgtctgctgatgaacaagaaaagtttattagtgaatacagtaaatatattaaacgaatgtatagcaaacagctatgcaagtattctgtttatgatatgaatattttgtctattaagagtccaaaagcagatcattacttaattaatactcggttatcacatgagaaagatgtcaataattttttgatggttgagtttaagttaattaatactggtaatggatttctgttgtctgatataaaaattaatagtgcaattagtttttctattactcaacgttctatgattaagaatatgataagtaaacagggtattgatggaatgatatcttatttccaattagaaaatgcttctgctaaatattaatcttgtgaatatctaagttaaagaaagtttttgtattcaatacagattatcatttctacgattgtggttatttgttgttttaacttttcaagtgataatttatgttgttgtactcaagatactgtattaaatattggttttgctctgttgtaatgtaagtgtcataaatagaggcatttttattagaccagggttttgttatgtctacaactaaaactgtggcttagggtgaatacattgtaaggtcgtttatattttttgggatggtataaacccattataaaatatgctaacctgttcgttagatattcaatataactgcgattttttaattaagagcatacacacggagtgcaaagcattgtactacactcttatgaggataccttaaggaaaattagtgagcctttgtaggaaaatagatactacaaaaacctactactgtgaataaaaaagtactgcgttttaatgaagtaaattctatacagcttttgcctgctgttgtaaatcaaatgcttttaactttaaagccatgcgactaatttttcttgctgcagtatttctgtgtataatttttttgttaacacacttgtgtaaatttgactcagcctttttaaaggtttcaatcattagctctttgttccctgcagctaaggcagccataaatttttttacgtagttatgtgctctgcttttccgcatgcgattgaccatagtgcgtttctttattactttaatcatctttttagcacttgggtgatttgccatatttaaataacctatcttatccttcactatataactctataagtaaattttaatcaatgcaagagcttttatatatttgtgatgatttagcaagttaaagaagacagtaatgtttaaatgttatgctgctgtttataatatgcttaacttcctgcaaacgatacattaacataattcagaaaatgtttagaaataaggtttcgtgctttactttaaagcttctttaattagtaagttgcttgctgttgaaattcttgtttcaagttcatttgtaaattcttgttttgttagtccaggataaataggagctaaaatttgtaaaatagcttttccaggtctttttttagcgggaaaaatactagctggccaaaataaaccagtattaactgctattggtactacgggaattgataacttattatacatggctgcgatacctggttttatagttactttttctcctggtattattcttgaaccttgaggaaaaattatgacagttctaccttcttgaacacgtaaacttgttgctgctaatatgtgtttcagagcttgaactttttgtttacggtcaataaatatcatttttagtagcataaagtatataccaaaaattggaaaatgctttagctctttcttgagaatgtatactgggtctttaaatatagtgaatagtattaacgtttctagaggagactgatgctctgatgcgatgatatatggggaattgtcaggtaaattttcatagccgcgtatttcatagtctactttatctataattttgcagaaagatagtattacttttatgccatgaactgaacactttatttttaatgacattgggaatatcaaatataatggtaaaaatatcacagcatgtagtactgtaaaaagtgttgacaatatgtaaaacagcattatgacctgacatttatattagttttgctatagtatagcctatagttctaaacgataaactatttttaatattatattagtttttctatttattactcatatttttgtaagtattgtatatctgtagtaataaggtagtagataatcatgcaatgtgaatatgtagaggctcatcattgcgtaagttattatctattttcttgtatagtataagtgtaactatataggatacagtgcttaatttgtatggttgtgtcagactcacacatgtatttggatcatttaatacctttattcaatacaatcgcttcttttagtgatacgcaatgatagtgaatatgtaaaaagcaaaagtaattcatagaatatttctgtgaagattgtaataaaaaatgttttttatagtgtgttgccttagtgtgattttgtttaatgtaggaaggttagaaaaagtttatactttacaataaatatttagaaataaagtcttgtgctttactttaaagcttctttaatcagtaagttgcttgctgttgagattcttgtttcaagttcatttgtaaattcttatgggagtaaacattaaataaaagctcaaatataggttgttatatgtttgatatgattttaatagaagtatgatatctatattgatttcggaaaatatatattttggaaatgacattaaagttcctgaattcatgttctaatataatgatcataatggcttttaatttaagtaattagcagtctgatttgttaataactttgtaaatgagtaagtatgacattttctataagtaggtgtgttaattagtcaaagtataacagtctatggtactgtgaatgaagtactgatgcgctatcagcaacattgtaaatcttgaattaatatttgtttcatataatatgattggtaggttttatacaaacagttgtaaggaaataaatgtcagttttgtcaattgttactgttcctgataaaagattgtcgttatgttctgaagaagttgaaaaagtagatcaatctataagaaaactagttgatgatatgtttgaaacaatgcatgctaatcaagggttaggattggctgctgttcaggttggtgttcataaacgtattcttgttatgaatgttccagaagagtttgaagattctgaggatattgagaatgttgaggataaaatagaaggttatgaactatatggaggtccttattgtataattaatcctaaaattgttgatatatctcaagagaaagtaaaattaaaagaaggctgcttatctgttcctggttattttgattatatagtacgtcctcagcgtattgctgttcaatatttagattataatggtaatgaatgtataataaaagctcaagggtggcttgctagatgtttgcaacatgagattgaccatttaaatggaacggtatttttaaaatatctatctaaatttaaacgtgattttgcaatagaaaaagtgaaaaagaaagaacgaactgatcttatataattgttggtattgatgtgagtgacttggacctattggaagtgttgaaattttatcatgagaatggtattgattgtacattagaagatgtgcagtataatgtttttacaagtaaaaatctatctttgcaaaatagtagtgatacagggtattgtatgaaagaaaaacaggcaagtattaaagaaaatacggaggattattatctgttaaaagctcaaagtcttgctgaacaatgtaatactatagagcaattaaaaagtgctgtagaatcttttgatggatgtgatataaaaaatttagcaacaaatactgtatttgctgatgggaatcctaaagcaagagtcatgttaataggagaagctcctggtgcgaatgaagatttaaaaggtataccgttttgtggtgctagtggtatgttgcttgataaaatgttgcaggcaataggttttgatagaactactgtatatattagtaatgctgtattttggcgtcctcctggtaatagaagaccaacagattttgaaatagcagtatgcaagcctttcgtagaaaaacatatagccttaattgtgcctcaaatgttagtattagtgggaagtactgcgtgttatgctatgcttgattctaagaaccctatatctagacttagagggaggtttcattcatatagtaatcagtttcttcagcatagtattactacgggtattatatttcatccatcatacttattacgccaaccaatgcaaaaacgtcttgcttgggaggatttaaagcagattaagcgttattttgatactttgtaatattattctagcatgtaaatgtaagtttaagaatgaatattgctttgagatgtgttcacgggtgtttgatttgtgttgtataaatagctctgtaaaccagggagagcttgtgtagtgaagagttgcttagaaggattaaaaaactaagcattatttttatactttatatgtttaatgctagctttattatgcgaatgtaagtttgagaatacatattatttaggcatgtataaaatgagtatgcttggtgtgtattgcatgtgttgataagtgagttggcaattagacgtaatacagtaaaaaaattttttctatatggtttaatagtatattgcaaatttatttattaatttggtcaatggttttaatataagtttgatgttttgtataatgttaaaaaatgtacaaggatataaaagtttttttattactactggaaatctaatagtagttgtaatagcttgtacttatttttaatgctggattatcgaaattaattgcgttgttaatctttacagcgagaacttttcatcaaggatattattgcaagagtgttgctgtattatttgctacatgaaaaaatttaaaatattctttatgttttgtaaaattttgttgcgtaaggtcgatatctgttaaccatacttgacattttatatctctgatgatttctaataatttttcttgatgatatgcatctaggtgagacataacgtcatccaataataggatagggtattctccaatgttttgttttgcaaaaacagaagataaaattaatgatagtagtagaattttttgttctccggttgagcagtaatttgctattaagtttttttctgaatggaatatttgaaaattatcgttatgaactccaaaattgactaaattacttagtgaatctttacttctgttgttttttaaatgttctttatatagctcaatagaattttcttggtctaataaattgaatacttggctttgaatttttatgattgctttaaaaaaagcatgagatttgctattttgagatagagtgttttgtaatgtttgtaaaacattaaatcttatacgagcaatgtttatgccattttctgcaattatgctttctaagctagataaccaaaagttatctatagagttgttatataataacttgcttctttcctgctttgctttgttatattttataatatgtatagcgtattttgtatcgaaaatgtgtgctattctgtcaaaaaatcttaatcgttcactttgtgattttaagaaaatatgatctaattgtggtattaaccatatgatgcttgtaattttatgtaatgtagtatagctttggtttttattgctaattaatatagcgcgtttgttgtgattccgtgaaattgcaataggataaataccgttttgtgtatgcatttgatatgaaacactccatggggaatttgaaagactgttttgcatgctttctgtgttcactcctctaatgccagtgccttttgatagtagagaaattgcctctaagatatttgtttttcctgcaccattttttccaagtaatacaactgatttactagaagtatctagctcaaggtttatgtagttacgaaagtttactagtcgcaaattgtttatgtaagatttttctatagatgacatctaataatattccttttttacttagaatggaaattttatacttatatcaattttttctgcaagaactactcacttattatattgaatactacgaaagtcttgtattaattataaagttgaaagtttctttatatatgaaatgtataattttgtgactgatttatgaatcagtaatgagctttttaatataataataaatttcatatcaaatttataatttataatgtggtagagaatcatctgatatataggattttaaagttgttttttaatatatagtgctgaatctgtaatttcgaaaagttgtgtgaagattgtgtatgtatttaaagtgtctgaggtctatgcttatgagctttatgaattagcatcatatattaagcttgtgacctggtagggaacaaaactaagacttaaaattatttagagtgtaaggtgtaatcctaatttgttgtttaaatggattattgtatttaaaaaatttatttgagaggtgtatgaactctgaagatgtgtgacatgcaagtttgtgttatagcagatttaaacaccataacatgattgccttttgaatatgtaatctattttctgcttcatcaaatatatatgaatttggtccatctattatttcagatgttacttcttctcctctgtgtgctggtaaacaatgtaaaaacatgtagttaggtttagctttttcaagaagtttggcattaacttggtatttgaaaaactcggttttgatattattttcataacccattgaaatccaagagtctgtagtaataatatctgcgtctgaaatgatgttatgaggatttgcatcatatgtgatattattacctttctcttgtgctgacttaagcagtaaatcaagattttttgaatattctaaagttgaaatgtttagtttgaagtttaatactgttgcagcatgtatccaagacactagcatattgttaaaatctccaatccaacttactgtagcattttctatagggcctgtcttttcttcgtaagtcataatgtcagctaagacttgacatgggtgactatgttgtgtgaggctattaatgactggaactgtgctgtgtttgtctaattcaagtagagaattatgttctaatatccttattactattaaatcaacatatcttgataaaactttagctgtatcgtagatggattctcctcttgtcaattgagtatccttttcattaagaataatagcatttccacctagttggtttattccaacttcaaatgatatccttgtacgggttgatggctgcagaaatattaaagctatatttttattcaataggtgtttgctatattggttaggtttttttttgattatagaactatagtctaagattgttcttagttcctcttttgtatgtaaattaagatctgtaaaagaacaaatatttgctttattcatacattttataacctggctctagaatttgacttttactattgatgtgaaaaacaatattgctactagaattattagtagaaataataagatgtaatttttgcttttcttgttgcttgacgtcttcactggaaaatgcctttttatgtaaacgagataatctcaagacaagggcatttcaacataaaatatgtttgatgtcaatagtttttgcttgtgtatactttatacttactgttcaaggcatcattgtggaagttttttgcaccattaagtgtttacgtatacacaagctttgatttggttgtgaagtagagtataaaataacttgaattattgtgctgatgagaaataccctttgagtgaataccataaatctttgaaaaaattggattgttttgtagtatttgattcatatatgatttctgtttcattggattctactttcttaaggttaattaaatccatatcactcagcgtaggatccgtaccatatgatgtttgtgtggatggtgatgtagtctgggtagtattgttggtattagtatcccagaattcactgttatttgtagtagtattagtactatgggtttgtgcggttaatgatgtatcttgaacggtatcattagtattagtacttccaaattcacttgtacttgtagtagttgcttttttggttttgggtttggttgttgtattttttcctttttgtgttttgggagtgttttttgttgtcatattagtatacccataattgtacttaacctaagaatgttaatattattttattaaataatagataatttagctgtcaaaaaaacgtttcttaattagttttatattgtatgtgtgtgtacatgttttttgtaatatattattgaatattgagggtgtaagaggttttgtttagatgttggtgattgtgatcgtatcagatccttgctatgttttaggtacgtaaaaaaattactaaaaatttttataatacatttgattatggaattatctatactaacagggttgtaaagtgtaaaatttgtagttttatataacatgttaaaataatgcgtgtttttacaattatagatgcttatgggttgctttttagagcatattatgctttaccaaatctgagaacatcctatggattacctattggtggggtttatggttttatcaatatttttttaaagtatatagagaagcatgtaacagattatttagttgttgtgtttgatactggtagtaagaattttcgtcataatatatatccagaatataaaggtaatcgtcctaaacttcctgatgacttaatacctcaattttcattgttaagagaagctgtaaatgcttttaatatagcttctgaagaagttgtagggtacgaagctgatgatgttatagcaactttaagtaagaagtattgtaagttgcaaggtgttaaagtaacggttgtaacgtcagataaggatttgttgcaacttttaaaatataacatttgtatatttgacccaataaaaaataaatatattgaagaagaagatgtacaaagtaaatttggtatatcatcaaatcagttgttggattttttgtctttaacaggtgatgcatcagataatgtccctgggattccaggtattggtgtcaaaacagcagcaaaattacttaatgattttggatcgttagataatttgttgctacatgtacatgaagttaaaacaaataagtgtcgtgagtctattactcaatatagtgaccaagcaatattatcccgtcagttagtaactttatgtgatgaggtagatatatgtggggatatagaaaaatatagttttcagatctctggaatacaagagttagtagaattcttaaaaaaatatgaacttcaatctttgatgaataaggttgataaatttttcaaagtaggtaatgcctcatcagctgttaatcaaaataccagtagtagtgataaaactatgggtggtgataaagttatacatcatgaacctcaatcttcgatgaatgaggttgataaatttttcaaagtaggtaatgcttcatcagctgttaatcaaaatgccagtagtagtgataaaactatgggtggtgataaagttatacatcatgaacttcaatcttcgatgaataaggttgataaatttttcgaagtaggtaatacctcatcaactgttaatcaaaatgccagtagtagtgataaaactatgggtggtagtgaagttatacattactccactgagtcacttaaggtgtttcttgaaaactgtaaaggtgaaggaataatggcattttatatggaaatggctgataacgttattgatagtgtttctttatcatataaggatgatattttactctatattgacaaggatcatgtgactgatgcactagaacttattaagccagtacttggtttaaattatgtgttaaaggtaatatatgatgtaaagacattattaaaagttattcctgatgtggaaattgtagcatttgacgatattatgataatgtcatatattttaagcccaagtgtacatgatcattcactacaagagataattaactataatgttaaacaggatgttgttaatgtaaaaacagcaataactttattattattgcataagttgttaaagaaaaatctgtttgtaaatcaactgtatactatttatgagagagttgagaagccgctaattcgtgtattagatagcatggaaaaggtaggcatgttgattgatattgatattttaaaaacattatcatctactttttcagaaaaagttagtgtactagaaaatgaaatatataggcttgcaggaacagaatttaatattgcatcttcaaagcagttgggaactgttttatttgataagatgggtataaaaaaaagtaagaaattgagttcaggtagttatagtactgatgctgaagttttaaatgatctggtatttaatgaaattgaaatagcggataaaatattacagtggcgtcattttacaaaattaaaaagtacttatactgatgctttaggaaaacagataaatagtaatagcggtagaatacatactttctattctatgatatcgactgctactggaagattaagttcaagtaatccgaatttgcagaatattccaattagaagtgaagagggaaatgctattaggagagcatttgttgcacgaaaaggatataagttagtttctgctgattattcacaaatagaattacgaataatggcacatatagctggtgtacaggcatttaaagatgcattttttttagatcaggatatacattcgataactgcagagcaaatattttgcactcaaagcctggataaaaatctaaggagaaaagcaaaatcaataaattttggtattatttatggtatgagtgcatttggtttggctaaacagcttggtatttctagatcagaagcaaatgcatatattgataattattttaaatcttatccggaaattcagtcttatatgaacaatattaaaatttatgcaaaaacttatggttatacacggactatttttggtagaaagtgttttataagagatattaatagcagtaatgctgcagctagaaatttttctgagagggcagctattaatgctcctttacaaggaacatcagctgatataataaagatgtcaatgattcatttgtttgataagattacacatggatcacttatacttcaagtgcatgatgaactattgtttgagattttagaagagtatgtagattatgcggtggaggtcataacaaaagtcatggaaggtattgttaaattatcagtaccattaaaagttgatattcgtataggaactaattgggctgatttagttccatatagtaaaaaatgatgagctcagttatataatagtgatgcggaataatcagtattataaagttgtgagtacagaaaggaattggattggtttatagttcctgtagttaaacaagcttggttgtactgatttggtgtggtacttatattattatgaactgtagacatgtaaaatgctgtgttaaaaatttgagctaggatatagggaataaagagtatagtgttactattagataaatgtaatgtagagtagtgtggtttagtgaattttgtgcacttgaaaaagaaaatgttaattttacagaaaagcacttttttaatattttcaatttagagttagtatagtggttatatatgtttttatttttacaatttaagtaacttctttaggcaagggatttttggtaaatttgcaatatgtatgatattagttttatgaaaaggattaaaaatgttgattgttttttgcgtacttgaaaattatgtgaaattcaatagactgtaagttatatatttcattatcaagattcacgtgttaacgaaaaaaaatagttttaatcgaggaaaagttgtagaagtctctagttctatattgtcagcagattttgctaatttaggtaagtcagtggaaatgttgacagatgcgggtgtagattatatccatgtggatgtgatggatggtaattttgtgcctaatatcactataggacctgttgttgtttctgcaataaagaaatatacaaccatcccatttgatgtgcacctcatgattaattctcctggtaattatatagaggcttttgttgatgcaggagcagatatgattactattcatgcagaatccgatatacatttagatcgtataatacagaagattaagtcttataagaaaagtgctggattatctcttgttccaacatctcactataatattttagaatatattatttttgagcttgatcttgtgttgattatgacagtaaatcctggctttggcggtcaacaatttatcacatctcagttagataaaatttcatgtgttcgtaatctaatagaaaaatattcattgaaaactaaaatagctgtggatggtggtgttaatattaagaatgctaaaagtgtaattgaagctggtgcagatattttagttgttggatctgcaatttttaatgcaaataacatgttagattatgtacaacaacttaagtcctctttctaggtttgttagtgaagttttttgaatgctgatgtgtattttccttttaatgatattatagccttttcttatgtatttatatgtaactgtaatatagagttaatagttacctttgatgctgtataattcttgtatgtccgaattatcagtttaaaaagttaagatattatgtaatgtcttgatataatcataaaacagaattttattatattgtaacacgtcatattaatgtgagtaattttatgaaatcttaaattttttatattagtgtattacataatgtagtcttagcaggtataatatagattgctagcgtaattttgaattatgagtttggtgttgtaaagttgttttggatgtttgtaatttataaaatgataatttcataagagtaagttttttgttatattttattaaatcttaaaatattattttaatatattaattagagtaaatattgtaaaatttgaaaggggttacactatagtttttaatgcattgatattagtgtaagtatttttatacctgttaaaataaaaggttttattgttgcgagcagtagattgtaatggattgatagacagtttatttatgtgtgctgcttaaaagtatttggtgtattattatgcgatttttgtgtttacatttggtgccgttttggttgttagaaactattggtagatatgtaataaatgtcatttttaatgtaggacactcttttattttttttgtgaagtttgtatataattgttttgtgcctccttattactatggggttatattaaaacagtttatagagatattctttttctcacttcctatagttggcataactgctatatttactggtgcggttttaattttacagaactctttgataatacataataatgtttcaggtgattttgtttcaggagttgttgttgttgcgatcgtaagagaactagggccagtattaattggtctgattattgcaggacgtgtgggagcagctattgctgctgaaataggtactatgcgtattactgaacaaatagatgctttgtttacattagatactaatccattcaaatatttagtcgttcctcgtattatttctgcaatggttgctatgcctatattgattttgtgtgctgatttaattggtgcttatggtggatacattgttggctcgtatcagttggggtatacttctgaaatgtatattaaaggagtaataaaatttttacatgctaaagatgtggctttaggtttggttaaggctacggtgtttggctttataatatcctttatggggtgctatagtggctattattgtagtggtggagctagaggtgttggattggctactacttatgttgttgttgtgtcatccatgtttatcatcttattcaattatattattactgtattttattcatagtagttgattttatgaattatatttctttatctgatttgcatatagactttcatggacatcaagtattgaagggaataagtcttgatattgcatatggggaatctttggttattgttggagaatcaggtagtggaaagtctgtgttaacgaaaacaatactggggttaatagctcctacttctggtaaagttattgtaagtggtgttgatattagacatgataagagtttgattaaaaattttggagttttatttcaaaattgtgcgttgtttgatagtttaacagtgtgtgaaaatattgcttttaacttacattataggttcaatcgtgataaacaattatcgaggaaaattgctgcttctggattgaatttggttgggttaagtagtgatgtgttagataggtatcctattgaattatctggaggtatgaagaagagaatagcactagctagagctattgttagtgaacctaaaattatgatattggatgaaccaacttcaggcttagatccgataatgtctgatgttgtgaatgaaattataataaaatgtcacaaggaatttaatttaacagttattactattacccatgatattaatagtgcttttaaaattgcaagcaaaatagctgtattgtatgacggaaaaattgttgcatgtgaatctgtgcaagatataaaaaatatagataatcagtatgttaggaactttatatgtcgaaattagagttaagattggtctcattgttagatagaatgatgatttttattatatgtgtagtagctttatatagttgggtattagtatgttaataatgcgtagaatggctatagcaaggtatactaagccccttatatttagtaaaatattaaactttgatccatcatttattaacatgttggaatctttagaagcagaagacatcctcttgttaaaagatgaacttggttcggtattttattatttaatcatgtcattgtatgatgtatctggtattcaaaatgattctagtggtgctataagagaacgccttaaaagggttttgttggatgcaattgagcaatctaattcagatcaaagtggagctgtaggttctcaagttagtgaaataagagaaattagagataggttaagatctgcataccaatccatttctaatagagtatgcagaactttaataagtgcattgggtaatgaaactctgcaagaggagacagactcaaatattacacagcaaagtaatctacaacgcaggttacaaatgtttcagtatgtaatacaagctgtggaaatattggctgataaacttaatacagctgttgtggagggtaaggtttcgcctgaacaagtttctgaatacttgtcttgtacaaatgaatctcatgattctattgctcctgatactatgagtgctttggttaagttatattccttaacggatgatcctcaacttacagatttagcgtattcattggtaaaaacattcttgatgaagtttggccgatataagttggatggtcaaggtaggaattctatgcattatgctgtaaacatgtgtagtccggaaaggcaagaaagttttttgtgtgagatgatacagccatcaatatatgaacgggtttcaatagttaatgaggtggatgcatctcgcaataatctaatgcattatgcagcatgtgctccatacatgaattatcaaattttaaagtatttagtaaaaaattttcctgcaatgatgacacaacagaattgctatggagatactccattacatattatgtcatatgtatattttgttaattttgcaaaaatactgtcatcttataacattacatatagagagaatatgaatgctttaaaggaggttgtagatcgtgggttgcctctttctcagatgagagaaagagttatgtcaattagaagaaatgatgaagccttatcaagacaacttaaagcttacgtagatgagagtgtaggaacttatcaattgttgctcactatggtgcctttgcggcagatatttgaagtaagaaataatgcagggcatactgtatatgatataatgaatgctagtatgagcaacataggcaatgagcgtcttgaggctttattgcaagatttttcccaagcaagcagtagattacctatatatgattgtaggattgattcacagcatgaactatgtgtgaatttatgtttttcaaataaatatagagttgttggtaaaagtggatatggacatgtattgtatacgcatgtgaagcgtatgtatgacttgatatcctataagttttctgagatctctgattctagaatgagatgcataaagattgaaaatgagcgtggtaacaacaggtatttaagtatgcttgttgttatgatgttaatggctttgtgtgttctaaataccgttttacattttaaaacaagatctattttaggtattgagcaaggcttatatagatctgtattattttcagcgatatctgtggttttctttgtgagtatttgtgtattttgtattgtatatgctaaatatgttgatgttgctgataagaagctaataatcgaggaagaagggtatgcacgaagtatattattatcacatttagatgttcaagaaacagatactagtcagagaagaagagaaggttaaaactttgcctatgttgaattaaaagtttgttgggtttgaatatcctctataaaaccatgttagcattctctatataaaatacaatctagtagtttgtttaggtgtgttttgtagtttgattctgcaaaaatatttaaacatgattttgcctgatttatgtaagttgttgctatacttattgatttttcaatcgcattgtgaactttaatataagatattgcctgctctaggtttggattgacagatatttgatcccagaattttttttcttttgacgttgcattttgatacgcaatgataacaggtaaggtggttttgcctgttaaaaggtcatttcctaattttttaccaaattgttctcctgaagctgtatagtctaaaatgtcatccatgatttgaaaagaaatgccgaaattatttccgaagttttttaatgcttctttttcttcattacttgtttgggctaaattggcggcggattcacatgttgcgctaaatagagcagctgtttttgcagaaatgatctctatatatttttccttagaaatatttatattatgactagatatcatttgttgtacttctcctactatgacatccttagatgcttgagatagtatggataatatattcaggttcttacattttataagccattgaaaggatattgcgagtaaaaaatctcctactaggatacttgctttgtttccccatataacattagatgttttttctcctcttcttagttcactttcgtctatcacgtcgtcatgtaacaatgtagcgttgtgtatcagctcaatagctgctgcaattggtactttattttcgttgttacaatttagcatcttgcatatgataaaaaaaattataggacgtattcttttacctccggatttaattaagtgttgtacgatttctgtgattaaagtgatatgtttattattttgatgtaaaattaaagattccattgaatctaaatcttgttgaactagtgattttaattgtagaaatgtattactaaagtcatttgtcatgtttaataagtctccagaatttttatgtactgtgttattgagttggtttttatttttatctgagtatacatcatgaaggaataaatacaaatatagtagtaggtaataaactcactatattgtatttacgcccagattttattttaagcgagtgtaatatataaaacagctgtaagcagtgtagtgttgagttgcttaagagctatagtaatttataaattcgatagggtgtggatgcagctgtaggtcctttacttctagcattttgagatttatatatgcatcaatttgatcattggtaaacacatctcctactagcagaaattctctattattatctagggagtccagtgcctcttcaagagagcttgctacagaagtgaattgttgtagctcctccttatctagtgagtacagatttttgtctattgctggtccaggatgaattttattttgtattccgtataacccagccattagctgtgcagagaaacataggtatggatttgccagtggatctgggaaccgtgcttctattcttttagcattgaggtcattttttggtacatacggtatgcggatggcagaagatctgttttcatatgaataagtcaaccaagttggagcttcaaaatgaggtactaaccttttataactatttgttgaaggatttgtgaatgcattaatagcttttccatatttaataattccacctatgtagtataaacaggtttctgatatactaccatcaggattgacaaaaatgttaacgttgtctttccacaaagattgatgacaatgcataccgctaccgttatcttttataactggttttggcataaaggttgcagttttaccataagatgatgcaactccatgtactatatacttacacttttgcacattgtctgcactgagtagtaattcatcatgttgaaatccaacttcacattgtgatgcagcaacttcatggtgatgtattaaaggtataatacctacttctttgaacattgttaacatttctgatcgaatgtcatgtaacgaatcaataggaggagtaggcatataaccacctttaacttttgggcgatggctattgttggaaaattctcttttttgaaataaaatatcgtgttctgcagaatctattttgaagtaagagttatacattcctgcataaaactgtgcgttatcaaatataaagaactctacttctgggccgaaataacacttatcagcaatacctgtagatagcatatatttatatgctttttgtgctatataccgtggatctttagagtactgagattgcttataaggatctactatattacacaatataaccaatgttgattgagcagaaaatggatccatgaaagctgtactaacatctggtagtaatatcatgtctgatttttctattgattgccacccaggaattgatgaactatcaaagttaactcctgctaaaagcacttgtgcatttatagtttctgcactacgtgttatgtgatgccatttaccattagaatctgtaaaccttagatcaataaaatttattgcatttttttttatgtagtttaaagtatcctctatagaaaggaacatgatgaaattaccaagcttaaaaacaaataggatatcaagtttcttatggttttgcaacatcatgatttataatttgttagggaattagttagaatgctatgtatttaattgagtgattatcttcaagaaaaatctttacttaatttcaggaaggtgattcaatatatgcattgtaattttatacctttgattgagatcccgtagctcagtcggtagagcgtctgacttttaatcagcaggtcgcgcgttcaattcgcgccgggatcactgtttttttaatgatctgtttctaaaatgaagttagagtctcaattcttaagttttttgtattctcgagggtattgtagtcaatgcactaatattagtatgttggatcaattaatgagccaacaatgtgtacatgcatatatcgggtttgattgtactgccaaaagtttgcatgttggtagtttaatacaagttatgattttaaggcaccttcaaaaatttggtcacaaaccaataatactactgggagatggtacaactaagataggtgatccttctggtaaagataaatctcgagctatgttatctgctagtgaaattgaggaaaatgcattaggtatctatgaggtattaaagaaatttattgtatttggtgatggacctcatgatgcattgttagtacgtaatgctgaatggttaaatggtttaaattatatagaatttttaagagatataggtaaacatttttctgttaacaatatgttgacttttgatagtgtaaggttgcgtttagaaagagaacaaaatcttagctttctagagtttaattacatgttattacaatcatatgattttgttgaattaaatcgacggtataattgtttattacaaataggtggatctgatcaatggggtaatattgttagtggagtagaattaggcagaaagttaagattaccagagctttttggtcttactactaatttactacttacaagctcaggtgagaagatgggtaagactgcacaaggtgcagtgtggcttgatggaaatatgtatagtcctgtagattattggcaatattttcgtaatgttaaggatgaggatgtaggtcgttttttgaggttatttacggaattatcgcttaatgaaataagaaatttagaacttttgcaaggacatgagattaatgagtcgaagaagatattagctactgaagcaactaggatatgtcatggagaagaaattgctcaaagtgttgctaatgatgcacttaaagtttttgagtgcaatgatgattctggattatcagttttttatgtaaagaaatatgatgtagaattagggttgcctataataaaattacttcaaatgtgtgaaatggaaaaaagtagtagtagtgcaagaagactgattaatgataagggatgtaagattaatgatgtggttgtattagatatgaattataagttatccttaaaagacttttacaatacatcctatgttaaattaagttgtgggaagaagcgtcatttaaaagtaatgttagagagtgatttttgatagggttttatattaaaacataggatagaggtaattatgatagattatgaagagatattttgtagcaagattaagcgtataaaagatgaaggtcgatatagagaatttacaggattctcacgtattcctggtcagtttccttatgctatagaatgtgatgtaaataacgtagttactctatggtgtagcaatgattatttgggtatgggacaaaatgaacatatgattcttgctatcaaaaattatagtagtagtgtaggtgctggtggtacacggaatatctctggcactacaaaggagattattgagcttgaaaaatcattagcagatttacataaaaaaccagctgctctgacttttgtgtgtggctatattgcaaatcagactactattagtacagtgctttctgtaataccagatattgtagttttttcagatgagaaaaatcattcttctatgatagaaggtattagatctactaatagagcaaagcatatatttaggcacaatgatcttaatcaccttgagactttgttaaaatctgttgatatatctgtacctaagatcataatatttgaatccttgtattctatggatggagatatagctccaattgcaaaaatttgtgatttagctgataaatataatgcaataacttatttagatgaagtacatgcagttggtatgtatggaagtcgtggaggaggtatatcagaacaagaaaatatatctgatagagtgacaattattcaaggaactctttccaaagcttttggagttatgggtggatatattactggatcaaaaaatgtggtagatgttgtcagaagctttgctcctggttttatttttactacagcattatcacctcttattgcatcatctgctagaataagtgttgagcatttaaagaatagttctattgagagagaaaagcaacgtgaggttgttaacaaagtaaaagaatctttttctaaggctggtattgactttgtcaaaacggatacacatataattcctgtaattataggtgattcagtggcttgtacagagatttcacgagtgttacttaaggaatataggatatatatacaatctattaattatcctactgtgcctgtaggtacagagagattaaggattactccaacaccttatcatacagatgaaatgatagataaattaacccaagcgttggttgatgttttgtgtaggtttaaaataatgaataagcaaaattaaaattcttgccaagcgtgaggaatgtgtattaatccttttgaaagtgaaaaaaagtataagtcaaatcttatattgtattcttcaaattttgtatgataagtaatgaaggattttgctgctttaataattgatctttgttgtttattagtaataggaatttctgatccaaatatactggttttaacttctataaaagctaaatatttatttttacaggcaatgatatctatttctcctagaatgcatttatatcgatgttttatgatataatatcctttacattttaaaaaccagattattaatatttctcctaagtaccctacaatgttataaataacgcgcttgtaattcttttttgtaaacatgtatggtgatattgtcagtaaaatcagtttagtatataaagttttttatatagagaaagataattctattatgtttaatgcatttatttgtcttcgcggacatttgtatctatattataaaaagtataatgctttttgattaaggttgggttttgctatatctgcagcctaatgttgtgacagaagtattgtataatagagattaccaatggtgattagtatattaaatttttaatgaagggaaaatggttgtgtatatatcttaatgtttgttacattatgaaaaggtgttttttcttgaataagtgctagaaataacataggcttagtaagtgaatttgatagttttttagtcgtggtttttcttagtgatataaatatagacttttctaaatataggatatgtgctctatcttgtagtggcgtcctcatgcttatttcaatattacttgttttattaaaaggcatatgctttggtacagattttgcaggtggtataataattgaacttcgtgcagatcaagtagatgttaagagtgttaatttaaaactgcaggaaaatggttttgtaggtttttctgttcaaggttttaaaaataatgatagagaactgatggttcgttttaaaaatgaaaaagattcagatcaatcggatactgttgagaaaataaaaggagtgttaaataaaatattgggtgaagtaacttatttaaaaatagattatgttggaccacaagtagggtataaacagatttttgaaggattgtgtgcaataatattttcattattaggaatgtttttgtatttgtgggtaagatttcagtggagatttgcattaggtggtgttttggctctgatacatgatgttgtattaacattggggttggttagtttatgtaatattgaatttaatctttcttcaactgcagcaatcttaacagttatcggttattcagtaaatgattctgtggtaatatatgacaggattagggaattgcttaaaaagaaactgcaaaaaaaactgtctgatgtcattaatatcagtattaacgctactttatcaaggacaatattgacatctggtaccactatgctagcgtctgtccctttaatgttgttatgtcagggtacagttagagaattaagcataattgtattctttggtatagctgttgggacatattcttcaatatttatagcaacaacttctttatctaatgatattaacaaaacctagattttagtagtacagaacaacttttttcctaagtaaaaaagctttttaatgtttagcaaaattgttaggtgtagtatcttgttttgtgactatagaaaaatttgatctgaaatacccgttgtattatgtgtgtgaaaataatgaattttagtatttgaagttttttactatctggttctggtgatggtatatgtaattctttggtgtgtgcttggtggataaactttgttagattttgaattgataaggttttaaagaattatattggttttttagcatagggttccgataggtaagttgtattttatttaaagaaatatactttgagcattttaaaaatcttcaatgataagtaagtttatgaaaacttgttaataaatggaacttatagcgattagtttttgctattggaggctaggaccggaatcgaaccggtatgtaaggatttgcagtcctgcgcatccgccattctgccacctagcctagttatgataaatttttgctatttttcctaccattgatatggcatcattttttggtctttgaaaggaattacgacctataattgatccatctcctccacctaattttattgattgtatttcttgcaataattcttcgtcggtttttgcttctccacctgaaaaaacaaccaatcttcttcctgaaaagcaagataattttatatactctatcctttgttttaaagatgtaatatcataaggtatagaatctctttctatattacttgttggtaatttaacctttataatgtttgctccaagcgatgctgcaatgtgtgcagcataagctactatgtctactgctgtttctccttgttttgaaatatcatttccacgtgggtatgaccatattacaactgctaaacctgctgcttttgcttctgcaattagctctcttgtttctcgaaccatagagaaaaaattgtgggaacctggataaatagtgattcctatagctgaacatcctaaccttagtgcatcttttacagaagaagttaccacttgatcagggaaactgttctttggggaaagcagtgtagagctatttagttttagtataagaggtatcagaccagcgtaagtagatgctccagcttcaagcataccaagtggagctgcgtatgcactaaaccctccttcaatagctaatagaaaatgatagtgtgggtcataagactgaggattctttgaaaaacttttagttggtccatgctccattccttggtctacaggtaatattaacaacttcccactgccagctactttaccgtgtaacagcattctcatcaaatttgcttttactcctgggttctcactttcatagaatcctagaatgtcctgaatacggttgttggctagcacaaagtttctacacattaaacaaatataaataatattagcaaattttttgcctactacaagaaataaaatatgtttacaatagcttacctactactttgataattgagatgttattaataaaaccatgcaagtaagatgttactaaaaatgtttaatagttgattcgttgtatcatgagattaagggtattaatgtgtatattagtaggtgatggagttattgtagaaggagataatttttaaaatttaatgttttgtgattaagaataagatgcctgaaataagtgtttttctgttctttagaagagagcaatgtctataattgaattgacaatgaatgtttaatactgtaatggtttataaaatgattttttgatattaagtaatgccaatagaagtattgatgcctgctctttctccaactatgaaaagtggcactataagaaagtggtataaagcagaaggggatgtagtaaaatcaggtgatgtaatagctgatatagaaactgataaagctgttatggaatgtgagtatacagatgaagatggtatcatgggtaaaattttttttgctgaaggaagcaaaaatatagaggtaaatcaattgatagcattgattgctgtagatgaacaggatttagctaaagttcattcatatgaaaaaggtgataatgttgtaaaaaatgagttagttgcgttacaagatagtcaacctgctcaagatgagtcagttgtattgcaaatgaatcaacaaattgtgaatgctagcgaagtattggttaattcatctaattcttctgaaagagttaaggtgagtcctttagcaaaaaaaattgcttcgaaccttggtgttgatgtaaatttggtaaaaggaacaggcccgtacggtaggattataaaagctgatatattggatgttataaatcagcatggtcacattgctaactctcctgaggatgcttcttttactgaaattagtagtatgcgtagagtaatagcagaacgtttagtgtattcaaaacaaacaattcctcacttttacgtttcaatagattgtcttgtggatagtttgttaaaattaaggttagaaataaatgctgaaaatcctgatactaaggttacagtgaatgatttcatcattaaagctgttgccatgagtattaagaaatttcctgaaattaatgtatcttggtctgatgataagatagttgtatttcctagtattgatatttctgttgctgtatctattgataatggacttatcacaccaattatttttggtgcagataagaaatctttgttagaaatatcaagagaagtgaaagcattagctagtaaggctaaatctggaaaattgaaacctgaagaatttcaaggcggaggttttactgtttctaatcttggtatgtttggtattaaagaattctacgcaattgttaatcctccacagtcttgtataatgtctgttggatgctctgaaaaacgagcaatggttgttaatgagcaaatatgtatttcaaatgttgtgacagtaacattatctgtagaccatagagttattgatggtgtactagcggcaaaatttttaaattgctttaaatcttatctagagaaaccatttttaatgttgatataaacagtttataagtttttcttaaattcatgccccttttttgattggcaaagtctatttctacaataatatttatcttaccttattttttactttgttgtgctgtttattattaatgtgtataggccatagttgttcagtcatattgttcagagaaaaaaatttacagaaatacaggtgtatatgtaagttgggatacattcattatatttgcaattaagtttctcgtaaaaatttgagctgagatttgtaagtaatactttgaaacatatttgggaataagaaagattattgctatgtattgacctagttctgttgagcagattatgaatttgatgtacctgtgggatttgattcagattgcttatcgtacctataaatgattataggattaatgataatgttgttgtgatagagaatacattctgttgttgctatctgcgaatagttctttatgtgttatgaatgatgttagtgtgcaaaagtgccattaataaagaatagtgttgtaggagggctaatttaccttattttttttcaatactatggtgtaaaaaggatgaagcagcaggagtttctgtgatgcaaactggagaagttaagattcctcctcttagtggatgtatagaatctgcagaagtattgaaagttgcagatcttgttgtgggtgcagcaacacttatcaaatttttatagaggttatgcaagaaatccaagaatgatgggccaggatattatattgtgcaagaacaatttagaaaaatattagtttttttaaaggaatacattttaagtatatttgtgatgtttgtacaggaatattttacgtattaccttctgctgtacgggtgtattctacatttaagaccagaaatgctatctattcttcaacagaaagtagagaatagtggcttattgattggaatcttgaatgtgcttgtatttttcattgtacggcaatattatgtgtacctaaattatctcataacttgatatatagtacatctgcgtactctaacccaggagcattaaatacgtgtactgcacggattgttttctgtatgcaaaggggataatctgtacctttaacggataagtggcttattagctaatccttctaatacatcatccatgaagtttggtcgagtacatcatataggattttatcgacaattgtttcagatgttgtgtaatcttatctctcttagatcaagtgatccagaattttcaacagaaatactagatttagcaatggtgagtgtttctatgatgcttagtactatgtgtaataattatagatgtcttctaaatgaatgagatggtgcatccatgaagtttggtagaatacatcatggagggttttatcgacaattgtttcagatgttgtgtaatcttacctctcttagatcgagtgatccaggattttcaacggactagatttagcaatagtaagtgtttttgtgatctttggtactacgtgtaataattatagatgtcttctaaatgaacagatggtacatcagatacaagaaatttgtgtgtaatgatgtggaagtatacgaaatcgcaaaggatattatgccaggaggttagcagtgtcatattctattatctaactttctatatatgtattctataaatgatgatggagtaatatgtgtagatagtataccattgccacgtatcacattagaaagatgtgatgaaaattttgctgctagggttcagcaaagtatagtcgataatagtatgaattttagtgttcttatagaagatttagcttcacgtgttgttcataatataatatgtctagtgtagctgcttgtgaggaagccatagaagcatattgtgcgttgtatgatgaagtaatatgctctgtgaaaaagatcaagctagaggattataaactgaattgctactctatattttagggatttagtatcaataaatcttattggaattcagaaatgaatagtgttttaaaatactcaaagttgttttggttatggctatattactgtaatttttatatgtctttgacgaagataagatagaataagtagacttatgattgtagtagtgtaaagctgtgatttcttaatagataggaattatagtttccctaatatagtttatatgtaaagtaatatgttaaaaaaattagttaaactatgagttgtattagtgttatacttgtgtttattacgagttttataatatattgtgtttgaactatttattgttattacttctattgttggtggtgctacagcattatttggtttaatggctggttctgataaagtggtaaaaaagaacaagaggaagagcagaaggcaaggcctaatagaagaaggacacgacaagctgagaaatcaagccaagaacaagctaaagagcaagatgtaggagcttcatctgacacaaaggtagaagaaaaaaaagatatacaacatgggtctgatgatggtcaagagaaagctaagggggtggggggagtagatggagcgtctggattgcaacatgtacctggtacatatgaatctagtcagttaaagcctgaaactggtgatagtgatacactatcatctgagttacaagatcaatatttacgtcagggtgcaaagccaaaaaaacgtgctcagggctctatgcgtcaggcaacggttcctgtagtatctactactgaggaagtagaaactcagtcttcaaaaaaagataaatatcgtgtaagagtaccttatcgtgtaagagtaccttttattcctaggtttgcgcgacttgaagaagaacagcaacatctacaatctcaacagtctgatgctggaactagtgaaagtgtagtaagaaaaagagaagcttgtgaaccagagaaaaaacatgttgctaaggttaagccatcaaagcctagtaccaaaccttttattcctaggtttgcgcgacttgaagaagaacagcaacatctacaatctcaacagtctgatgctggaactagtgaaagtgtagtaagaaaaagagaagcttgtgaaccagagaaaaaacatgttgctaaggttaagccatcaaagcctagtaccaaaccttttattcctaggtttgcgcgacttgaagaagaacagcaacgtctacaatctcaacagtctgatgctggaactagtgaaagtgtagtaagaaaaagagaagcttgtgaaccagagaaaaaacatgttgctaaggttaagccatcaaagcctagtaccaaaccttttattcctaggtttgcgcgacttgaagaagaacagcaacgtctacaatctcaacagtctgatgctggaactgataaagattcactacaaagagcagaggctttaacaatgcgagagcctggttttcctaaaatgtatacaccgcaatatcctgtgagaatattgcaacgtgtacagcataaaaaagatgacgctgttgtaagtaagggtgtagttgaaggtagtgcaggtgatgttgagcaaggatttgcaaggttgcaaattcaaggtgatgaagcttcaggtgctgtagaggtaggaggtagtcaagttagtacgggtctcgaaagtgtgttagtatctaaaggctcaagtgtttttaatgtagcgtattttccgaagtttggtagggggagtaaatcaaaaaggttatctggtcgaaaatatcgtgtgttacaagaagaatatagattacagctctgggattttacagatatgcatttacaacatgctcgctttatagttagaaaaatgttttgtttggagtgtggtgttgtacgtctaaagaaagatctactatcttttataggcaatagaatagaaaatcctgaattctgcattcttatttttaaagttgcttgccttgggcattgtatgtcagtgaccaatattattaaattctatcatagcttattctataacgagatagatgatcaagtattagaagaatgtgtgcaagatatcgttatatatgcacaagatacagagctatctattactaaaatagctggtgtgttttctaatagttatactagctatgtttcaaaaaatactgtgccccatccgcctggtttttatcgtcatgtgttacgattgttgtgtaatcttgtttctgctagagttagtgatccagaatgtccagttgatgtattagactgtgtgatagtgtgtgctgcacaactgttgggtactgtgtataataattataaaagttttacaaaaatgcaaggcgtgaatatagataacatgagctttttttcagtagtagaaaatatgggatcaacaagacattgttgtggacagcttggactagtgtgttatggtcttttgaattgtatgacatatatgtatagtgtaaatgataatggtgtgaaaaatgtgggtggtcttgctatgccgaaaatagttgtggaacggtgttctgaacatttttatggtgtggttgaaaggaatatggcttctggtaatatgggatttcatgttattatgggagattgtgctgcacgtgtttgtgcggcagtggatagatataatgtaatggcttgtgaagatgagatagcaggatatgagggcatatataatcaggtaatgcgtagttctaaagaggagaaagggccacaaaggtaaaactccatttgtttttatttggttgtacagtcaataaagcatgtattagggttgtatattagatcttaataggatcataaaagtaataattaatgtaagtgagtttttgtagaaaataccgttattcatgtatgcatttaattttaatatgttttaaagttactgtttgtaagaattcaggcaataaagcatgtgtgaaagttgtggattagatcttaatataaatcataaaagtgatgactatgtaaataagtttttgtagaaaatgcttttataattttcattgtgttattcatttgtgcgtttgatcgtaatatattttagaatgactgtttgtaagaattcaggcaataaagcatgtgtgaaagttgtgggttagatcttaatataaatcataaaagtgatgactatgtaaataagtttttatagaaaatacttttataatttttattgtgttattcatttgtgtgtttgatcgtaatatgttttaagattgctgtttttaagaattcaggggattttttgtaaattcctgtaattggtgaattagaatagtgttatttcattttattaggtagttcctgttgcatcataattggtgtaaaaagcgctattgtttcttgtaaaaagtgttaaaatatgataatatattgataaaaatttaataaattctttttccaatcatatagattaagtgtgttattatgttattctctatagttgctgttgttactgcagctgctattgctgtagtcatgatgatgagtggtgatgaaattaaaaaagcagcatcgaagtcatctggtaaaaaaggaagggcaaaaagtagtaagacaagtagtcaggtacagaagagtctagaaccagtaactagtgctggtgagcaggctcctactgttcaacaggaagaaatagtacaactgccctctgattctcaatttgagtcttctaatcaagacattgtgcaaacggaggagcaggttgttaagaaaaaagaagacgtaaagtctggggatcaatctcagaaaaaagctgttaaaaagaagttagtgttaagagacttttatagtggctttaaaggttctagtgaaaaagttcaagttgatattactggtggaccaattactggtcagcctactatgttaagttatgctgaaagagctaggattgggatatctagtaaagaaaaggggaaagctgttggtcaacctattacattaagttgttctgaaaaagctagtagtagtgtaaaggggaaaaaaggtcctcatgcggttagtcaagagggatatgttgttcagaagggagatccggggagtaagtatttaggggaggaggtaaagccaaaagtttctggtattcaacctataaaagtaaaagaagagagtaaatctagttctatatcagagagtgtggtaaaactgtcagatcaaccttcaagaaaatccctaaagaaattagtattgggagactccaaggcaggtagtgttcctggtgtgttaaaaagccctattgaaggggatactgttgctcgaccttctttaagctatgctgaaaaagttagaattgggatatctagtaaagaaaaggaggcagctgttagtcaacctactgaattaatttgttctgaaaaagctagtagtggtgtaaaggagaaaaaaagtcctcatacggttagtcaggagggaagtcaagagggatatgttgttcagaaggaagatctagaaagtaagtatttaagggaaggggcaaagccaaaagtttctggtattcagcctttaaaagtacaagaagagattaaatctagttctatatcagaaagtgtagtaaaaccatcagatcaaccttcaaggaaacccctaaagaaaatagtattggaagacactaagacaggtagtgttcctggtgtgttaaaaagccctactgaaggggatactgttgctcgaccttctttaagctatgctgaaaaagttagaattgggatatctagtaaagaaaaggaggcagctgttgctcgatctgctgtattaagttatgctgaaaaaggtaaagttggaatatctagtgaaaagaagcagtcaaaagatcctgatgatgttattgttcttagtactagtggtaaatcagtaaatgatgacttacaacctgttcctcaagtattaattccagtgcaggttgtgcctgctcagcacattgttagtcgtcctgttatttacaaacatttgtcatatggttctaaagctggctatagtcttgctatacagcaatttagagaagagaaaatatgggattttgcaaaaatgcatatggcatatgttcatgactcactaaattatatgttttttgtgaaaaatggaaagcttttactaaagcctgaaattcgagatcttctattaaaaataactaacaatatagatctatgtacctttttaatgaaaatggtaatgctagatcatctgatgagtagactttgtaagttttatgttagtgatagcctgaagtactgtgcaagtcattttcgtaatccaagtcttgtagataacttacttattcagattttgagtaaaaaacgtattgactgtataacaatgtcacaagaactgcgatataatcttgctatgtgtactaaaggttatgacgctgaagtttttgagctacatgatagtattttttacagtgaagtgttaagcctatactgtgaatttatgcatgcatcagttgatgatgaacaatctaaaactttgtgtagtttggtagagttatcttgtgctttacagtttggacaaatgtatcatgtacttggtaagtctaaacatatggttgttgagggtatgaatatagagaaaatggaaaaagacttgtctgaaggaaaagatgtaaaacagtttatttttcgtgctagaatttttggtggctactgttatgcaatgcgaaaagcattaagacatatgtatattccaactgataaaaatactgcgtgtgcggtagctggattaaatgttccatctagaatgttgaaagtatgtagtaaggacattgctgagatcattgatgatcatgttaaaagaaataaaatggactttagtgtttttgttaataatatggtaagttctgtaaagagattcatggtgaatcgacatacaaggtttctagtacgagaagacatttcaatatatcaggcaaaaataagtagtaaatataaaacaataggacctgatagccaggtttgttcattataggtttacagactttatatatgttaacaatattttaaaggtgtgtgataagtaatataagcatgtgagagatttttgtacttattgttgaataagtgttgaaattgttgtttgttttagactttaaaaaaatttttaaagttagggcagtatattattaagtagctctccatatgtctagtagtaattattgtattcttgtgaaaatattgagaatataataatgttaattatgaagaatttaattttttaaactttcattatcaagtaagtgtgttgttatgataattcctgtggttactactgttgctgcagctgttgttgttgtgataacgttaatgaatggtgtaggactgcaaaaggagcgtcaaaatcatcttagaagtctggtaaatcgaagaataaaaaggcaagtgagagtgaaaaggcattggttgatgtaaatgggcaagatgtttctgagaaagaagaaaaatctagttttgtatcagaagatatagaaaaactatcgggccgctctttaagaagacctcttgaaaaaagttagtgttaaaaagtctcaagagttaatatactcttggtacattgggaagtcgtgatgtagatggtgtacataatgttggttatgcgaaaaaagaagaggctacttataactctgaactaactgttgttcacacaaaaaatttagaaggttaatatttaaaagagtgtgcaaggtcaaaagtgcatggaagtcaagctgtagggatagaaaacagagtgtaatgttactaaggaaaaaagaagaaaagaagcctacttctgtacggaagatatactgaaatcactattcacaagagtctgaaggtgagttagcattaaaaggcctcaaggttagaccattagaagatcataagacgagtttgggtgatattggttatgtaaggaaaaagaaagatttttgtgttgcaagttctggacgagttgttactcaagcagaaagttgagaaagtagatatttaagggaggtgtaaagccaaaggtttctggtactagaacttgtttcaaacaagagtaggtagtgctaaaaaaactaacatagaagtatctgtttctagaaaggcttgaaaagaaggaagcgaagtaggaaaaagtatttgatgttgcttcttctattcctgttggtgatattgtaaaaactggtttggttgttcaaccaatagctaataaagatttcaaaagaaatttgagtaaaaaggatgatcttgtagccaaaaatatgcttcgaatgtgtagtaaaacaattaggaagaaaatacaatattgtatcgacgcactatggttttactgtttttttgatgatatactacgttatgtaatgaggttgctatcaagtccaacgacaagatttctttttaaaaaaagacccaaaatatatcgtaatctgatagatgacaaaatactattagaccaaatgtaccttttcctataccataaattttaatgtattgttggttttggatgttagtacttaaaatgtatctaacatgttattaactgtatatatttatcaatatcctataaagtgtaaaaactgtaggtaataattctgtacattattactaattgcataattttgatacatttcaatattactgcttacttagcaagtttattatgactttcttcatattttaaaaaccagaaagtagggctatattattaattatttatataattagtaaaaaagtttaatttcttgatgaaatgttgaagatatattaatattattataaattaaattaaatatttcttaaaatatgtattaataaataaaaggtactttctatgataattcctgtggttgctgcagctgcggctgttgttgctatgataaggttgatgaataatggtgaaaagagaaagttatcgaaatcatctggtaaatacaataagcagagagaattaagaagtagaaagacatatcagttaaagcaagtgaggacggggatagtagttggtgtaaatgagcaggatattgctggtgaagagcaggagatgccgttgtcacagcaattccctaatttgcatcctgaatcttgtcaagatattataaaggcagaagatcgtagagtgggtgttgttactaaaaaaaagaagaggaaatctagtcctgtatcaaaggatatgataagatcatcggatcaactttcaacaggaactttaaaagaatctgatgagtacggtaaaaaaaggaaatcaaaaaatagaaaaacaggtagtccgttaaaacaagtaaagacggtaatagtagttggtacaaataagcaggatattgctagtgaggagcaggagatgccattgtcacagcaactctctgatttgcatcctgaatcttgtgatcaagatattgtaaaggcagaagatcgtagagtatgtgttgctactaaagagaagaggaggaaatctagtcctatatcaaaggatatgataggatcatcggatcaactttcaataggaactttaaaagaatctgatgagtacggtaaaaaaaggaaatcaaaaaatagaaaaacaggtagtccgttaaaacaagtgaagacgggaatagtagctagtgcaaatgagcaggatattgctggtgaagggcagggaataccgttatcacatcaactcctgcactttgaatcttgtgatcaaaatattgtaaaggtagaagatcggaaagtacatgttgttactagagaagaaagaaaatctaatccagtattagaagataatgaatatttaaaacaggatgcaaagtcaaaagttcatgcaggacaagctgttggacaaccaatgagttgtgctgaaaaggctaaagctaaggtatcttctgttgaagagactgtaggaaaagtatgtactgatcagaaagttaaagaagtctctgaatgtaaaaatgatgtttatgatactagcgtacaacatactgcagtaagttatgttgaaaaggttaaggttggtttatctgatgatctaggaaagacacttcttcctatagatttgaaaagaactgtgagtcaacaagatttgaatagtgaatatttaaaacaaagtgcaaagtcaaaagttcatgcaggacaagctgttggacaaccaatgagttatgctgaaaaggctaaggtatcttctgttaaagaagctgtgggaaaagcatgcactggccagaaagttaaaggagcctctggatttaaaaatgatgttgatgaaacattgagtgctagtatgcaacatactgcagtacctggaatggtaactccaacaaatattattcctgctaggcatattgtaagtggagtagctgttttcaaacatttgcagggttattcgttagaagaataccaatctttagtggaaaattttaggaaatctgtagcgtgcttttcaaagatgcatatgtcctatgcgtatcaaatattgcataatacattcattgtacacaatggacagattgtgttgaaacctgaaattgaacagtttctattgaaaacaaccagtaatataaaactgtgtacctttataattaaaataggaatagtagaccaagttatggctaggcttggcaattcttatggttgtaatagcataaaatattgtgcaagctattaccatgattcagaaattatagatgaaattcttattaggttttatggtacatcatattctagtttttcagaggtgtcacaacaagtacgtcatgatacagttgattgtcttaagaaacgtaatgtgacaaatgtttttaagctacatgatagtagcttttattcagaagtattaagtgtgtgttgtaactttatgggtgtaagtaataaagacatagaattgcacaaactatgtagttttgttcagttatcttgttgtatacaaattgcgcaaatgtatcacatgatgctaaaggtaaaatattctgctggagacaagcaagattatgcacaacaatgtatatctgaaagacttgcaaaaggacctgcaataaaggattttatgtatcgtgctttactttttggtagatgtgcttgtaatgtaaggaacacatttaggcatttatatagtccagatgataaaaatcatatacgtacagtatctgggttaaacgttccgtattgtatgattcgagtaagtagtaagggaattattccaaaaattgagagttatattaagagaaataaaatggattttggtgtttttgttgatgatatagtaaattttgtcagagatgcattgtatcgtccaggtgaaagaacttgtatcaaagaagacataaaaacatatcacactatagtaagtagtcgatatgacaatatgataagtaattgtagcgtttccagatgagaagaagtttgtgtaaaagaggacaaagaacatatactctatgataagtagccgatatacaacatgataagtaattgtggtatctccgggtgaaggggtttgtgtagaagagaagacaaaggacattaccctatagtaagtaaccgatatgcaaatgataggtaattgcggtgtctccggtgaagaggtttgtgtacaataagtagctaatatagaacctgaatctccttctttttatttattgtagatttaaatgtgtttcattttgaatgttgtttaagtcatgtgtaggattgtgtgtattatcaatgttctaagatacattaggtaataattgctgaatatattcaattacttgttattttaaggattttctatgtttggagatttagaaggtaagactttattgttattgtcttgttgagtatatatcttaaatgttgtggtcaatggaaaaaaggttgtaatttcttgctaacatattgaaaatatattagaattatttatgaagatttaaatcttttttgatttcattacatcgaataagtgtgtttttatgctaatttctgtagttactgcggttgttattcctatagtaataatgttaatgggtgataatgaagctgcaaaagagtcacctcgtaaaaagaaaaagtcaaaaaataaaaaaacaggtagtccgttaaaacaagtagaaactagaacaataactattgaaagcaagcagagtgttgatactgaagaacgaacgggactgttatcagagcaactttctagtatgcaccttgaatcttgtgatcaggatattgtaaaagcgaaaggtcaggatgtacaacatcttactgaaaaaaaagacggggaaacatctcatgttttattgggaggtacaatcaaaccacgtagtcgacgctctgggaaattaacattaagaaatgtggggagtgctagttttactactcaatcggtaagtgatgctgcaaaggttagtggtgcatctaatgttggtcatgtagaaggtgcttcttgtattccagaccagggcagcgccactgtaggcgtgcaaagtttagaaagtaagtatttaaaagaaggtgcaaagccaaaagttcgtgtaggacaaattgttgaacaatcagtgagttatgctaaaaaagctagtactggaatacctattgttaaaaaagatgtgaaagaagggggggggggggaggagtgttagtcaagaaactactgttgtagttcctgttggtagtgttacaaaagctggttcaactgtttgcccagtaagtgatgctgagaaatctgtaactaagagatctcctgttaaagagagtataggaaaagcatgtactggccagaaaattgaagaagcctctgggttaaaagatgaagttgataaaacattaagtgctagtatgcaacatgctgcagtacctggagtggtagcttcagcaaacgttattcctgctaagcatcttgtaattagaggaaaggttttcaaacatgtgaagcgttattcgatagaggaatataaatctcaaataaaagagtttagggaatctatagcgtgttttgcaagaatgcatatgtcctatatgtatcatatgctgcataatacgtttgttgtaaacaatggaaggattatgtttaagcctgaagttgaacagtttctattaggaataaccagtaatatgaagctgtgtacttttgtgattaagataggaatagtagagcatgttatgagtaggatttgcaggttttatggttctgacagcataaagtattgtgcgagtcattaccgtgatccaaagttcatagattcgatacttgttatactgcatgatgcatcacattttgatttttcaacgatgtcatatcaagtacgcaacagtatggctaattgtgttaggcgatataacattacaagtgtttatgagctacatgatagtagtttttactcagaattattaagtatgtgttatgattttgttcgtgcaaagagtaatcagagtgtacaatttcaagaattatgtgattttataaagttgtcttctactgtgcaacttgcgcaaatgtatcacatgatactaaaaaccaaatgttctactggaaatgaacaagataatctgcaaggacttttattacaagaacgtaatatagagagtctgatatatagttctgtattttttggtaagtatgcttgtcgtgtaagaaaagcgtttaggcatttatatgctccaagtgataaaaaccctgtacgtacagtatctgggttaaacattccatatgttatgattcaactgaatagtaagggaatttttgcagaaattgaacattgtgtaaacgcagaaaaaatggattttaatgtttttgttcgtgatatagtgcgttatatcaacaagctattatcgtatccacgtgaagaaggttatataagagcagatataggtaaatattgcgctatggtaagtagtcgatatagtactatgggagctgacatagttccttcttctcttcattgattgtagatttaaatgtgtttcattttgaatgttgtttaagtcatgtgtaggtattgtgtgtattatcaatgttctataaggtgcattagggaataattactgaatatattcaattacttgttattttaaggattttctatatttggagatttagaaggtaagactttattgttattgtcttgttgagtatatatcttaaatgttgtggtcaatggaaaaaaggttgtaatttcttgctaacatattgaaaatatattagaattatttatgaagatttaaatcttttttgatttcattacatcgaataagtgtgtttttatgctaatttctgtagttactgcggttgttattcctatagtaataatgttaatgggtgataatgaagctgcaaaagagtcacctcgtaaaaagaaaaagtcgaaaaataaaaaaacaggtagtccgttaaaacaagtagaaactagaacaataactattgaaagcaagcagagtgttgatactgaagaacgaacgggactgttatcagagcaactttctaatgtgcaccttgaatcttgtgatcaggatattgtaaaagcgaaaggtcaggatgtacaacatcttactgaaaaaaaagacggggaaacatctcatgttttattgggaggtacaatcaaaccacgtagtcgacgctctgggaaattaacattaagaaatatggggagtgctagttttactactcaatcggtaagtgatgctgcaaaggttagtggtgcatctaatgttggtcatgtagaaggtgcttcttgtattccagaccagagcagcgctactgtaggcatgcaaagtttagaaagtaagtatttaaaagaaggtgcaaagccaaaagttcgtgtaggacgaactgttgagcaatcagtgagttatgctaaaaaagctagtactggaatacctattgttaaaaaagatgtgaaagaagggggggggggggagtgttagtcaagaaactactgttgtagttcctgttggtagtgttacaaaagctggtccgactgtttgcccagtaagtgatgctgagaaatctgtaactaagagatctcctgttaaagagagtataggaaaagcatgtactggccagaaaattgaagaagcctctgggttaaaagatgaagttgatgaaacattaagtgttggtatgcaacatactgcagtacctgaaatggtagctccaacaagcattattcctgctaagcatcttgtaattcagggaaggtttacaaacatgtgaagcgttattcgatagaggaatataaatctcaagtacacgagttcagggaatctataatgtgttttgcaaaaatgcatatgtcctatatacgtcgtatactgcatggtacgttcgttgtaaacaatggaaagattatgttgaagcctgaaattgaacagtgtctattaggaataaccagtaatatgaagctgtgtacctttgtgattaagataggaatagtagagcatgttatgagtaggatttgcagaatgtatggttctgacagcataaagtattgtgcaagtcattaccgtgatccaaagttcatagattcgatacttgttatactgcatgatgcatcacattttgatttttcaacgatgtcatatcaagtacgcaacagtatggctaattgtgttagggaatataagattacaaatgtttatgagctacatgatagtagtttttactcagaattattaagtatgtattatgattttgttcgtgcaaagagtaatcagagtgtacaatttcaagaattatgtgattttataaagttgtcttctactgtgcaacttgcgcaaatgtatcacatgatactaaaaaccaaatgttctactggaaatgaacaagataatctgcaagaacttttattacaagaacgtggtatagggcatctgatatatagttctgtattttttggtaagtatgcttgtcgtgtaagaaatgcatttaggcatttgtatagtccagatgataaaaaccctatacatacaatatctgggttaaacgttccgtattgtgtaattcgaataagtagtaggaaaattattccaaaagttgagagttgtatcaaggcaaataaaatggattttagtgtttttgttgatgatatagtacattttgtcaaagatacattgtatcgtccaggtgaagaggttcgtgtaagaaaagatataagtacatattgcactatagtaagtaatcgatatagtactatgggagctgacatagcttcttcttctcttcattgattgtagatttaaatgtgtttcattttgaatgttgtttaagtcatgtgtaggattgtgtgtattatcaatgttctataaggtgcattagggaataattactgaatatattcaattacttgttattttaaggattttctatatttggagatttagaaggtaagactttattgttattgtcttgttgagtatatatcttaaatgttgtggtcaatggaaaaaaggttgtaatttcttgctaacatattgaaaatatagtaatattatttatagagaatttaaatcttttttaatttgcattacatcgaataagtgtgtctttatgctaatttctgtagttgctgcggttgttattcctgcagtaacattaatgttaatgagtggtgatgaagctgcaaaagagtcacctcgtaaaaagaaaaagtcgaaaaataaaaaaacaggtagtccattaaaacaagtagaaactagaacaataactattgaaagcaagcagagtattgatactgaagaacgaacgggactgttatcagagcaactttctagtatgcaccttgaatcttgtgatcaggatattgtaaaagcgaaaggtcaggatgtacaacatctgactgaaaaaaaagacgggggaatatctcatgttttattgggaggtacaatcaaaccacgtagtcgacgctctgggaaattaacattaagaaatatggggagtgctagttttactactcaatcagtaagttatgctgcaaaggttagtggtacatataatgttggtcatgtagaaggtgcttcttgtatgctagatcgtgaaagcactactgtagacacacaaaatttggaaagtaagtatttaaaagaaggtgcaaagccaaaagttcgtgtaggacaaactgttgaacaatcagtgagttatgctaaaaaagctagtactggaatacctattgttaaaaaagatgtgaaagaaggggggggggggagaggaatgttagtcaagaaaaaactactgttgtaattcctgttggtaatgttacaaaagctggttcaactgtttacccagtaagttatgctgaaaaagctagaactaagatatcttctgttaaagagggtgtagaaaaagcatgcactggccagaaaattgaagaagcctctgggttaaaagatgaagttgataaaacattaagtgctagtatgcaacatactgcagtacctggaatggtagctccaacaagcgttatttctgctaagcatgttgtaattaaaggacttgtttacaagcatgtgaagcattattcgatagaggaatataaatctcaaataaaagagtttagggaatctataacgtgttttgcaagaatgcatatgtcctatatgtatcatatgctgcataatacgttcgttgtaaggaatggaaggattatgttgaagtctgaaattgaacagtgtctatcaaaaataaccagtaatataaggctgtgtgcctttgtgattaagataggaatagtagaccacgttatgagtaggctttgcaggttttatggttctgacagcataaagtattgtgcaagtcattaccatgatccaagggttatagattcgatacttattgggttatatggtgcgtcatattctgatttttcaaggatgtcatatcaagtacgtagtaatatagtttattgtgttggaaaacatggtattgcaggtgtttttaagctacataatagtggtttttactcagaattattaggtatgtgttatgattttgttcatgcaaggggtaagggtgtaaaattgcaagaattatgtgattttatgaagttgtcttgtagtatacaacttgggcaaatgtatcacatgatggtaaaagtcaaatgttctattggagatgagcaaagtgatatacggaaacttgtatcccaagaatgtagtgtagggtatctagtatatcgttctttactttttggtaggtatgcttatcatgtaagaaaagcgtttaggcatttatatgctccaagtgataaaaaccctgtacgtacagtatctgggttaaacattccgcatagtctaattcgactaaatcatagaggaatttttacaaaaattgaacattgtataaacgcagaaaaaatgagttttaatgtttttgttgttgatatagtgcgtcatattgacaagctattattgcatccgcgtgaagaagtttatataagagaagatataagtacatattgcgctatagtgagtagtagatatagtactatggggcctgacatagattcttcttatcatatattgtagatttgaatgttatcttaaattatgttttaggtattgtgttgtattgtcaatgttctataaagtacgtttaatcaatggttgctggtaacgtaatctttatgcgtttcagaatgatatagtaaagagcattttaatagtttttctgtagttggataatcaagacagtaagattgtgttactgttgttttattaagtagaatcttatattgatcagtttaggtatagtacatttctttatgcactgtaaaggtgcttttagatttttaagtattcattaatagtgatatatgatatctaacgttaacatattgtgaaatggataaacttgaaaatattttaataaccttaggtaagaattctctatcttatatttaagttattagaagctaatagatttttatcttctgctgtgagaaatgaatattgggggttttaaccacagtttgttaaattgcttagtaggcaatcagataaaaacttattctaaaatttttgccaaatgtaagcagtatatatttgtgctataagcattataaaagttaaagatttacaatgcttatagaaactgactatcaataatattgcattattactgggggttaatatctataagatattggtatttatatattgaattttatgggaatatatgtttattgctcagatgtgagcataattttttgcatgtgtggcatcataatttctatgaaattcttcactaattcttcctgctgattttgtgataatgttttttgatctgcattaagtgcagaagtaattaaaggtgttagtaccttgtttaactctggaattgctgacttcacttcattttttatacatgctttcatttttggatctattgttgtattacaccctttttcaacatagctcatagcgttatctaaacttttatctagcgataattcttcattcatgatggttgtacctaaaattattactgatttaaattttattatatatttattaataaaatcataattcttgttgagagttgatttttttggtatagtcattacatttgatacggttcttgaaagtctgtgttattgttcttaagattagaatgctcaatgtaagatcgataatgttttgagtttgttgaaaaatactccgcattatttgtgtaatgaattgtaagtttattatagttaatgataacacaattaagtactattttataggttgtagtctttacaaagctactatagttgtagttctgatgttaatagtggatattatcaaaacaaatgatggacttttattttgtacagttataaaggtaatataaatgtcaagggtggcaattattgattttggttcgcaatttacacaattgcttgctagaaggataagagaactaaatgtttattctgaaatttttccgcatgatatagcatttgattacataaaagatagtaaagcatttattttatctggaggtcctaagtcggttctggattttacaggaatgcctccaatagttcacgatattattgaattgaataaaaaaacttccgttccagtattgggagtgtgttatggattacaacttttaagtaattattttaactcgacaattgtacatgggtgtggtcaggaatttgggaaagctattctaaatgttgtcaaaaaatcagaaatgataaaagatgtgtggaaagtaggagaccaaccctatgtgtggatgagtcatgcagatagtgtatatgatactccatgcggatttgaagtcatagcatgtagtgtagtgaataatgcaattgcgatgatcagcaatgaggaaagaagaatttatggtgtacaatttcatcctgaagtatatcacactccggatggggtaaaattacttgctaattttgtcagaatagcaggttgtgacaataactggacagtggaatcctttttagatgagcaagagaatcttataaagaaacaagtgggagataaaaaagtaattgctgctcttagtggtggtgttgattctagtgttgctgcagctttgacttatcgagcaataggtgatcaattacactgtatctttattgataatggcttactgcgctataatgaagcagaaaaagtaagacaatcgtttgttgatcagtttcaaatgcctgtaactattgttgatagatcatcagtatttttagataaacttcaatttgttactgatccagagcaaaagcgaaaaataataggaaaaacgtttattgaagtatttgaagaagaagcgaataagatagggaacgtagaatttttaatgcaaggtactatataccctgatgttatagaatctggtggctctgttgggaaagaaagtgttactatcaaatcacatcataatgttggtggactacctgatataatgaagttacagcttgttgaaccactaaagcttttgtttaaagatgaagtgagattgttggggaaaaaacttggtatatcagatgaaatattaatgcgtcatccattcccaggacctggtttagcaattagaataataggtgaaattactcaagagaaggttaatatgttgcaggctgccgatgagatatatattaatcttatcaaaaaatataatttgtacgatgttatatggcaagcgtttgcagtgctattgccagtgaaaacagtgggtgtaatgggtgatagtagaacttatggttatacttgtgctttaagagcagttacttctagtgatggtatgactgcagaatgtttcccatttggtgtagacttggaaactaagataatcttttatgagtttctacaggatgttagtaatactattgtgaataatgttcaaggaattaatagagtggtatatgatactacatctaaacctccagctacaattgaatgggaatagatattgaacacttataagttggagtgttattatttgattaatgtgtcatagagtttgattgagtcattttatgagtatttaagttttacaaggaaaatttgaatagcttagtaaaactgataaatttaagtttgtgccgctaataatgttataaatttgtagtattatgattttaggcttatacagttatagagatttaaactttattagtttttaacaatcgacatatttaataagtttaatataatgtgactatctgttaataattaatgttaaatttttatttttaaatatgtatcaaataggaaaaaatatattaactaacaactttgagaaatataaaaaaatatagtagaaattgtggttactggttatagtatacaaaaagtagaattatgacttaattgatattataggtttataaaaatttatatatgaataagtgatttgttttacgaaaagttaaaaattagtattgataatgttatgtaaaattttgtgtgtgaatgcctttaaaaaacataaaattttgagtgcaatatacacgggattacattacttctgataagatttgaagtgtttggtttcttatttttatctgtttatgttatataagcaagatatgtgtggggttattattaatttgggtaggattatggttaaagaagcagtattagaattggatggtcaaagaataaaattgccggtgttatatgatactcatgggaataaggctgtagatattacttctttatataaaaatacaggaatattaacttatgatccaggatttatgtctactgctgcttgtgaatctaggattacatttattgatgggaataaaggtatattatgttataggggacatgatatagtaaatttagtaaataataataaaagttttatagaaatagtgtatttgttattttatggtgttctccctggtcttgaggatttgcaaaattttatatcgcaaatttctcaggaatataaccctcctaagatagttcatgatgttataaaatcattcccacgagattcacatcctatgtctatattaatggcatgtttttctgcgttagcatcatgttatcataatcaggataatagtgcagatcaattaaagtgtgctaagttagcagttgctaaagttgcaagtataatagcactgatttatagatatataaccaatcaagattttgtcgaatctgatacaaagttatcttacagtgaaaattttgtacatatgatgtttgatatttcttcttataagttcactcaagttgttgctaaggctttggatattatttttgtattacatgctgatcatgaacagaatgcttctactgctactgttagattatctggttcttcaggtgcagatttatttgcttgtttagtggcgggaacagcgactttgtgggggccagctcatggtggagcaaatgaagctgtgattaatatgttaatggcaattgaaaagccaagtaatgtaaagcaatttattcaaaaggtaaaagatggtaacaagagtactagacttatggggtttggtcatagagtatataagaattatgacccacgtgctaaaataatgtataaaatttgtagagaagtattaaataatttaaatgtgaatgatccattattagaaatagcattagagttagaaaatatagcattacaagatagttattttattgatcgtaatttgtatcctaatgtagatttttattccggaattgttttaaaagctattggaatcccggttaggatgtttactacattatttgcattagctagaacgtctggttggtctgctcaatggtatgagatggtagcagaagaaaattataaaatatgtcgtccacgtcagttgtatactggtaatattgcagaatgttaacataattttgaattatcattgcttattgttttaatattattgataattatgcgcatattaattgtggatttgtatatgtatatcttgttaaccataaaaattatttagaagtgtatataattagaaatatgtgttaatatatgagggtaatcttaggatataaacatagatataagttaaaaatgaagttatatactgtagttgtaatattacgttaagtaaaaattttttatgcttaactatggataattatcttaaagtgttgatgtcctatgagtttactcgcaatgttttattggtactaatgacggtaattattgatacattaaatgatatattaacaaaatataagttagatatagagaattggttttttaataaatttactaagtataacccggttttgaatatttcggttgatttaagagtatctgattataagattgctccggtagatactaatatttttcctgcaggctataataattttactgagcaatcccaaatttatgcttctcgattgttaagggaatatgtagttaattatgcgaactgtagcaaaattttaattatagcagagaatcatacaagaaatttaaaatatattgatagtttgattgttttaaaaaatatagttaataatgcaggttttgttgttgaagtagggatatgtaatataaatcaaaatatagaactgatttcatcaacaggacgtgtgataaattgtttatgtcttactaatgataatggtgtacttcgtgctggatgtaggtttattcctgatcttattttagtcaataatgatatgactagtgggattcctgaagtactacaaggtttaaaatatcaaagtattatgccatctttatttttgggatggtttaatagaagtaaatctaatcatttttctatttataaaaagttatccaaagagttttgtgagagttttaatattgatccttggttaatttcagcatttttctctagttgtagtaatatttgttttttcaacagtcaaggaattgatgatattgctaatgaagtggatgtagttattagcaaaatacgtaataaattccaattatatagtattaaggaacagccatatgtgtttgtgaaagctgataatggaacttatggtatgggaatattagtagcttattgtggagatgatatcttaatgcttaataggaaaaagcgtaataaaatgaaaaagattaaagatggtaatgttgtcagtagtgtaataatacaggaaggtattactactagagagatctttaatggttatgtagctgagccattagtttattttatagggcatactccttcatgttacttatacaggtatcattctgtaaaggatagattttctaatttaaattctgtaggctgtgactttatagatataagttataaacagcaagacatattgtattggaatataattggaaaaatagctgttttagctgctgcaattgagatgcatgagatatcaaatgttaatgtaatggagcaaaattgcttactaagttaaattgctaatcttatgtgttgtttttgacaatattattatacaaaagttggtaaatatatctgttgattaacataggatctataatgtgttattacagtatagtcataaatatgggatccctgtatcttttctgataatgtaaagcaagtgagcatccaaatactttatgtgctattgaaggtagtataagctcataatattacatcaaggttttatagtcatatctgttgattaacatagaatctataatgtgttattacagtgtagtcataagtatgggatccctgtatcttttctgataatgtaaagcaagtgagcatccaaatactttatgtgctgttgaagggagtatactcatatattacatcaaagttttatagtctttgtacacagggttttgtacaatgttattaatactgaagatcttagttaattacttcctagtaatcattgttgtgaggtaatacttaaatattacttcttggtttgaatctgattttttgcactgtatttctatctctactagtttttttattatgttgttgatttcggcatatgggattgcagatacatgtttttttattgtaggaattgatttgaaaaatataggaggatgtatagattttattgcttgatttattggttcaccgttttttatggttcttattaaatattctagccttgaaaaatatttaataaggatccttattaaagctattggagtaaatttatttttgagtaatacgtcagaaaattttgtaaagttctctagatttttttctgcgacagatacacataaatcttctgaaatagggtctatttctgtcagtaaactttcttgaatattttgaattgtcaagtttttgttgtttcctatatatagtataagtttttcaagttctggttgtaatgcattacagttttgtgataagacattgtgtaaatactgcaatgttgtagcattatattgtactttgttctttgttaggaaatctgatattatgaatgaaagattgtcattatcatctttatagcatcctatggaagcagcatttcgtgaattgtcataatattgtcttaaggtagaatcaggagataactctccagaagttataattatatagttattacctatgttattacttaagacgtgctttagttcctgggagatagatttttctccattagctagtataatcaatttgttttgacagaacatggatatggtagtcagctctataaataatgtgctgggatttttgtttactgtagaaaagtcaatgttgcttatagcaaattcagagtttgtgttaacatgattaatgatttttttcttgtacatgctaatttttccataatcgttgccgtagatgagtatattgtttgtaagttgtagattgttgaaaaaggaatgtaattttgatgatgtaattttcacaacatttattttactaattaaataaaaagatatcttaataaggtatgttttgacaatctattttactatttaatataatttcaatggatgtttgtatgaacttaaatattacagtagagtgggttgaaatttttttttggatcctagtgattaggtaatgtaaagagcatttagtaggggtttctcacaatctattttgttttaaatgtaattaatggcatgtttgtaggtatttctttattgtgtagaaatggtttcaggattcatttttaaatgtttaatattttgttctatacttaaattgatgaattttaaagtcgagatattatatgtataggctataatttatctataaatgtttataattattagcaatgtagttttgtaatatcatattgatatgataaattagtgacattattttgttctgttggtgtaatgcgatgttacttaaatttgaattaatgttagcactgcgttatttacgatctagtagtagtaaattcttatgttctatgattactatgttatctttagtagggattacgttaggagttgctacgttaattgtagttatgtctgtcatgaatgggtttggagaaaagctattaaattgtgtagtagggttaaatggtcatatagtaatttattttaatgatagtgttgattacgattaccgtagtattgcagagtcaattaagggtatttctggagtaaaggatgctgtgcctattactgaaaatcaagctatgattaaatctaatagtaatgtatctggagtggtagttcgaggtatagaaaaacaagatatagagcgtaataatataatagtaaataatatagtaagaggtagtattgatgaatttaatgacggtattgctataggtatcaaattggctgaaattctacatgtcaattatggagataaactaactattgtatcatcagaaagtatatctacggttataggtaatataccacgtatgaagacctataaaattgctgcagtatttgatgttggaatgtatgagtatgacagtacgttggtatatatgcctttgcatgcttcacaattgtttttccattatgataatcgagtaaaaagtatagaggtgtcaattcttgatgttaataaatcatcagaaatgttagagataatagaaagtaagacaaatatgaaaggagaagattggaaaatgcagcagggaagttattttcatgcattaaaaatcgaaagtaatgtaatgttttttatattgactttaattataatagttgcaacatttaatattatttcaagcttgtctatattagtacaagataaaaaaggagcaattgctataatgcgtacgttaggtgtaacacgttgtggtatactcagaatattttgtatgtgtgggttttttataggattgataggtacaatactaggttgtgtattaggcatagtagtttctctgaatattgatggaataaaaaatatgttagagaaaataagtgatagtaatatttttgatcctgtaatttacttttttgatactttgccttctgttttattagtagaggatgtggtaaaaatatctttgttatctttatttctatctttagttgcagctattcttcctgctagaaaagctgcttgtcaagatccagcagatgttttacgacatgaatagtaggggttaatatgctagcaaaagaagtttggggatggttttttatgatgttgataaccacttcttgctctatatgtgctgttttttcttatttagatgtaaaaaaggatctagtagtatttagtcagcaatatagaaaagtcatagaaaatgatgtacggtctgttttagtgcaggtaaatcaaaacttgcttaattcatatttaagtaaacaaaaggaaaattgtcctgtacagcgtatcattacatcagagaataatgatatcataagctgttctaatgaagaatggcttgcaaagcttttgttgtctgtcattaatttaagagaagcatttttgggagatatatcagtaaaaagtataatctactcaataaaacctatgttacttaaacttgatgattataaaattaatgaggctgtagctgagattgaaagattagatagtaaaaaattaactacatttaataggttaaaattttcgttcaaaaaaattgctcgtgagttgcattattcgcggtctaatatggttcaaaaagttttctttaaatgggttgtagtaaaaaatcaacaagatgcactacttcataatttaaaagaagtagaaatctaccttgatgataatctttggagtgatgcgttagatctttctaggaaggaattatcatctgttgcagaactagagctatggatacaacagttagaagatgtagtatctatggagaaaaacatatcattgatatatgatcaattgtcaaaatatataattaagttacctggtgtttcatgattacaagcgttttaatctttgttattgttgcacttactatagggctatgggtaatagattgcgatggtatcatcagaatagattggttaggctatgatatagaagtaaatatcttatttacgttgtttgtcattgctgttgttttccttcttttaattctattagtaagattcattttttgtttttctcgatgtgtgtatcgatataaaagagatttacagaataagaaaatggtcttgttggaacagggttacatgtatttaaattgtggagatgttgaaagagtagaaaagattatagtaaagataggaaattttgatcatccatctttatttttgttaaagggaagggtttattttgatactggaaaatacatattggctgaaaagtattttacgcaatttgtgaaagttgtaccagttatagatgcttcgttgggtatacacttgttgaatgttattatgcagatagaagatcagattcaacagctgagtttattgaggaaaatgctggagattttttttaaacaatcttggtcagctatttttaagttaactatatatcggatttctagagattggggtaatgcaattgaagaaatgaaaaaaataataaagttaaaaataaatctgcctttaccttataatacacaagagatgcttaatgtgttttattatgcattagcaaaacaatgttatgatattcaaaagtatgatgatggtttaagagtacttgataacattaagaattgttctcaacagtgtagtactgctgttacattgttgaaagctaaattttatatagatactgataagaaacgtaaagcggtgaatattcttgaacatgaataccgtattaatccacaccctgatattgcaaatttctatttagatattatgcagcatagtagtcatgctatacataaattatatagttttaatactggatattactttagtatatatcttatagcacaggatgctataaattcaggtgaatatgatacagcaatgaaatatttaaatcatagtttcaaaactaaaacttatatttctttgtattttttagtgttaaaactaaaagtattatcacaaaactataatgaacttttgtattggacagataaaattgcaaaagatgctatagcagataagtattggagttgtacaaagtgtaaatatacccctacctgttggcattatgagtgtgatggttgtaaaagttttaataccataatttgggtttaagttatatgggtattgaagacgttgtattttttataatatcttggtgggttgttttatttttaatactgcctataaaagttgaggtatctgatagtccagtaattggtactgcaagtagtgctccggtaaaatcttatttacttgttaaatcaataattgcaactgtgacatcaatgttacttactggattatatatttatttgaaaattaaaggttacatagattttgaacgtatatatgatcttgttacttttgtatagaaaggttattaatcaatttacactgtaacttttagtttatatgtgtctaagttgaggagttatttgagtgtgtggtgagttgttattcagttaaaagtaaaattggtatattttgatggtatataatatacccattatttatggacttatagaatatttacaagtactggagtatcgttattaagtgaaaaattattgatgtgttgttggtataattgtttacaaagtagcactattatattgtttattaagatataaaatacttgactggtgttgttataatggtataacattttgctgttttatgtttcctttaaaagcatatgattcaatatagaggtggctatatagcatcttgttatgctcaagcattatttagtgtgtcaagtaatgtgaactctatttgtaaaaatgcagagtttgtcgttagtgttcttgagaattgtaatgatatttctttatttttatctaatcctagggtgtcaagggaagataaagtaaagcttgttgaagtaataggggattatattgattctatattagtcaagtttattatggttgttattgaaaataatagaggaaatatattgctgcagattttgaatacctttcttgatttagtaaaaaaacataatagggaagttagtatctctgttacttcatgtgctgtattaacaaagcaagaagaagaaggtatatgtgatgcattatttgagaaatatggaaaagttgtcagtataacaaacaatatagatcctagtattttaggtggttttattattagggtgaattttgacgtaatagatgtatctttaaatagttatttacaaagtttgcgagaacttagtaaaatggctatacgtagtagtataagtgaatagtagggtacggtaatgaataatactatatctccaggtgaggtgttaaaagttattaaggagcgtattgagaattttgataaccaagtaaagtctgatagtgttggtgaagtgatatctattaaagatggtatagctttaatatatggcttagaaaaagcaaaatttggagaagtagtagtttttgctaacggtattacaggtatagtattagggttagattgtgatactgctagtgttgttgtatttggtgatgaaagaagtgttggggaaggtgatactgcaaaatgtacaggaaaattgatggatgttcctgttgggttggagttgctaggaagggtagttgatgcattaggtaatcctattgatggagctggcagcattgatagtaaaactaggttgccagtggagattaaggctccaggtattatcgctagacaatccgttactgagcctctgcagactggtattaaaattatagatatgttaataccaataggacgtgggcaacgtgagttaattataggtgatagaaagacagggaagactgcaatagcaattgatactatcattaatcagaaagcacataatgatgtagtgtcagaaaaggaaaaagtttactgtatttatgttgcaataggacaaaagaattcttctgttgcaagaatagttgataaattacgtgtaagtggagctttagaatacacaattgttgttgctgctggggcttcagatactgtatcgttccaatatcttgcgccatatgctgcttgtgcaatgggagaattttttagggataatggaatgcactgcttgattgtatatgatgatctgtcaaaacatgctgttgcttatagacaaatgtccttgttgttaagacgtcctccaggtcgtgaagcatatcctggtgatgtatttttcttacattctcgattgttagaaagagcagctaaaatgtctgacaaagaaggaggtggttcattaactgctttaccaataattgaaacacaagctggtgatgtatctgcgtatgttccaactaatgttatttcaattactgatggtcagattttccttgaatctgaaattttttataaaggtttacgtccggctgtaaatgttgggttatctgtttcaagggtaggttctgctgcacaaactaaatcggtaaaaaaagttgctggttctgtaaagttgagtttagcacaatatagagagttagaagattttgcaaaatttgggtctgatattgatgtgcattctcagaaggtattagatagaggtagaaggatgatggaattgttgaaacaaaaacaatattctccattatctgtgccggagcaagttgctgtgatatttgctggtacaagtggttgtttggatggtgttagtgtaagtgatatcagtagatttgaagaaatgctccttaaagagcttaatgaaaattatccagatgttttaagtagtatattgaataattttactgatgatgtaaaagacttattattagaaattataggtaaggttacttctaattttgaatagttctgtattatgtaggtatgacttatgaatgactatatgaatgcgagatttcctattacaaaaaatgggtttgcaaaacttgagttagagctagagtcattgaaacatgaaaggcctaaaattataaaatctatttctgaggcgcgagagttgggggatttatctgaaaatgcagagtatcatgctgctcgtgaaagacaagggttagtagaaagtaaaataatggagttagaatcgaaaaaatctagagcagaagttatagatgtttcaaatttatctggggacactgttatgtttggggcaactgtaactatgtctatatatgatgaacagactggtaatactgatgaagtagtgtaccagattgttggtgagtatgaagctgatatttctaaacaaatgatttcaataaaatctcctttagttgtatcattattagggaaaaaagaaggtgatgttgtagaagttaaaactccaaagggtgattatagaatatataaaattataaaaattgaatttatataaaagaaggttatagggttaatgggtattattgtatcagaaaattcgagttttatctctcctgtagagcatattattgaagattctaaacaaggtaaaatgtttattttgattgatgatgaacaaagggaaaatgaaggtgatttggtagttttagcagaaaaggtaacaagtggtgtaattaactttatgataactcatggtagtggtattgtgtgtttatctattacagaagatttaatgcataaattggggttggagtttataccaaagaggcatgttaattgtaatagtgcgtcttttgcaacttctatagatgctcgttatggtattacaactggtgtttctgctcatgatagagcccatactatacttacagttgttaataaaaatgttacagaggatgattttgtaacaccggggcatatttttcctattgtatctaaaaaaggtggagtgttagagagatctggtcatacagaagcgagtgttgaaattgcaagaattgcagggttagctccagtagctgtagtatgtgagttgatgaatcctgatggaacaatgtcaaggatgcctgatattatagagttttcccagcgttataacattaaagttactagtatagataaacttattcaatatgtaaaagcaaactagtgtatgttgggagtgcaatttttctgtggatatcgtagttgagaatcgtaaagtaaggtttaattattttattattcaggaatttgatgctggtattgtattaattggtagtgaagtcaagtctttacgccagagaaaagtcagcatagctgaggcatatgttactgagcggaatatggaattgtggctatgtaatttacatatttcagaatataatcaggcaagtactagaaatcataatcctaccagacctaggaagttactattgcggaaaaagcaaatatataaaatatctggaaatataaagaatgatggctttactgttgtaccattgtgtttatattttaatgataaggggatagcaaaagttaaggttgttattgtaaaaggtaaaaagttgcatgataagagagagacaataaaaactagagattggaatagagaaaaaagtcgtatactacgtggcggaaactaatctgatatagagaaaatagtttatagacttaactttgttgtgatacagagtttggtttaaagtagatatatcaatacatatttattgtaaagcattctcctattactttgcaaaaataggaggtggtaatgtttcagctttataaagttcactggttagtaaattctacttaaactagaaatttttcttcatttttgttgtaaagtattctcctgttacttacaaaaataggagagatgtgataatgtttcaactttataaaatttactggttagtgaattctaatgaaactagaaatttttcttcatttgtatcaattactggttgagtagtgtacactatatgttcagcattgcagacagcttttaagtcattttctagtgaagtaggaaagttacagccttgactatttatgattagcttatctattttatattttactgataattgggcattggcttttattttacgtacttggttaagaatttctataaaatcttctcctaatagctcatctgatgcattgtatagacttatatttgcaataggccagttattgtggctatgaattgaatttttgttgttataaagtgtattgtatatttcttctgtgatatatggcataaaaggtgctaacattttgagtaactctcttaatataaaggatagagtgtgtactgcacttaagtgttcctgtttacttgtagattctccatatgctctttttttagacaattcaagatagttatcgcaaaaatctttccagaaaaaagattctatgtagttaagtgctatacaatactcaaaagaattgaaactttctgttgctttgatgataactttatatagttttgaaagtatccacttatccattgtttctgttacgtgttgtaaatctatttctgaatattgaccaataaacattgaaacaaatttacttgcattccaaagtttagtagtaaaccttttgcctaatttgagaacgtcattggaaaatgtggtatctgctcctaatttggagtttgcagcccaataacgtactacatctgcaccatattcttctaacaatttatttggagttagtgtatttccctttgatttactcatctttgttttatcttctgcaaggcaccacccgctgatcataatgtttttccatggaatatcattattatggtaataggcctgtagaatagtataaaatgcccaagaccttatgatttcatgactttgagctcgtaagtcagcatgagttgtagatatattatggaattgagtggacaatgaactagtagcccaggtatccattacatcggtatctgcttccacttctgtgtcttggtatccttccggtaaatcgttaattggatctactggtaatttgttgatatcaggtaagataatttcaccatctgcttttttagaataccaaactggaaatggtacgccaaaatatctttgacgtgatatacaccaatcccaatttaagccttctatccaaatttctatttgtttacgcatagattttggataccagttgattttttgtacttgtttcaataattcctgctttatttctactactttgataaaccattgatgacttaatagtatttcgataggtgctcctgacctttctgcacattttacattgtgaataatttcctgtttatgctttagtaaattgttttgatctaatatttcaagaattaatgctctagcttttgttattggtagcccatgtaattggttacatacactttttccttgagtggtatcactacttagattgaatatagtgcctgatttgctaataatgattttagtatctaaattgtgtttgttccaccagtatacatccatttcgtctccaaatgtacagcacattacaagaccagtccctttatctatttttacttgatcatctggtaatatttttactctgttgccaaatattggcactatcgcattttgcccaaggagatgctgatatcttgtatctgaaggattaaaaaatacagcaacgcaagctggcataagttctggacgagttgttgcaatgttgattggtattcctgcttctgtagaaaatgttattgtattcatgaacgatgatatctcattttcttcaacttcagcacgtgctatagctgttttatcaatgcaatcccagaatataggttgtagttttctgtataattttcctttattgtataaatttataaatgatgtttgagatatcttttgtatatttttgctaattgtgtgatattctagatcccagtcgtagctaattccaatagattgaaaaagttgtttaaattgtattctgaattcatttgatacttgtgtacatattgtattgaattctttgcgactcatatctgttgcacgtattttttttgttttttctactaacctttctgtgggtaaaccgttatcgtcaaatcctataggataaaatacatcttttccaagcatgcgctgatatcttgcaataaaatctgtatgacaatagctaaagacatgcccaatatgtagttgtccagatattgttggagggggagtgtcaattataaactgattatttccagagtttttccatttatatagttttgttatattccagtgtgtgttgtattttgtttctatatttttaaattgatatttgttattaaaaatagactgcattgtaaaatattctgcttaccttttcctgctcaagtatagagaattgcaattgttgaaacaatgataattttattaatatactacgtaatctatatttgttgatatgaacctatattcaaagatgttgtttgtcattttactgaggtgatttttgtattttcttatctaaagttggtacgtttttaatgtgttgttgatgctaatgttattatattgtgtataagaagaacgccttgggctatattttataatataccttgaaatatttatttactataattgttttctgacataatatcaattattggttctctataaagctacactttgcaagttttaattaaagccttataatagataattcttattttttgaatattattaagaagttataatggttagtttaatagagctcccgcttttaatggcgtgtgtattttcagtagtttatccatttgttgttaatatatctttctgttggtcgaaagtactgacaatgttgatatttatactgacaagttctgctgttggattgttgttgtatatacacattgttgatgatttttcattttgtaatgtatactataattcacatacgactaaacacttattgtataaaatatttggtatttggggtaattatgaaggttctattctattgtgggtgtggataataagtctatatagtttattattagagattttacttgataaagatgatttcaaaagaatatccatttcaatacaacatgtaattaactttggattcttgttatttaccttggtagcatctaatccttttatgaagatgcctactgttgaatatgaaggattgggctttaatcctatattacaggatacagggttaatggtgcatcctcctattttatatttaggatatgtaggatttagtgtagtattctcacttgctgtagctgggataattctccaaaaagatagtgtagaatgggcaatgattataaataaatgggctctagttgcatggtcttttttgactttaggaataggattaggtagttggtgggcatatcgagaattaggttggggaggattttggttttgggatccagttgagaatgtatcacttatgccatggttactgggtacagctttaattcatttactgcctttagtgagaaaatttaacctgttctataattctgcagttttattatcaatttgttcgtttgtaatgagtctaattggtacatttttagtaaggtctggtgttttggtatctgttcatacttttgctaatgatccagaacatggattctatatattaatgttaattggaataataattagtagtggaataataagttttatttgttttacgaagaaaactcagaaaagagaatatgattttttattgttatcgaaagttacaatgttgttgttcaacaatgttctactgttaacagcatttgctatagtgtttattggtactatatatcctgttatattagagtttatcactggagatgttattgctgtaggagctccatattataatactctatttaattatttgatattctgtactttaatattaatgataattactttaggattggatgaggaaagaaataaaattttaataaagaatttcaagttttctggatttgtagttttattgatttttcctttcatgatagataataatttttttattgttttaatacttttattatcagtttttttatttttatcagtgttggaagcatactatagaaaaataaaaatatttacagtgtcattttctgaaactataaaattggctaaatcttgctctaaaaaatattattctatgctaatagcacatatgggtgttgctgtatttatgtttggaatcattggttctattgtatggggtgaaacctatgaactttatatgaaggacaatagtttgattaatgtaaaaaactttcaagttgttttatctggattatcttttgtaaaaaataaaaattacgatgctattcgtggaagatttttaatagtaaaatctggtgaagtgttgggtaaagtatttcctgaaaataggttctatgtagttgagggagtaagaaatgctgaaagtgctatatatcgacattggctatctgatatttatattgtaattggtgatatagataaggtgaaaggtatagcagtaaaagtgtattataaaccttatataaatttaatatggatgggatttttgttagtagcatttggtggcgttataggattgttatctagtcatattattacaaagaaatctttagtacttgaaacatcaaaaaccaatggtgcttcttgtacatgaaaaatatggagtgacgtgttgtaagtatggaagttcaagtatatcaccaaatctgccgttattcaaagcagaattgtgttaaatattacatagaatcaaagtgttgttattacatgctatctatgttgctgtaagtaaggtaatattattcttctataactgcaagagcttgatgttgacatagttgatttttaagtttgtgatgatatataaaaaacaatttttattctaaattgatatagcaagtgtataccaaatttttgtaataatgcaaattgataatgtgtatttattgtggaataacaattgcatgatcactttttataggcagaattaggttgacattctaagtaataaaagtatggaggagtatgagcaagtttataattttgcctgatagaagtattatagtcttctatggacaagatgttaagcaattacttaatcaaactacaacgaataatgttttaaatttaagtcaaaataaagctatttattctttgcttttgagtcctagtggtagatatatttatgacttctttattgtgcaatatggtaaatatgtattgttagattgctgtagtacagaaaaagaggaaattatacaaaagtttttgtcgtataaattacaattaaaaatagtaattaaggaaaaaaaacactataaagttggtgtgtttattggggatcagtatgataggaatgagtgtggatatacttattgtcaaggtgatactatattctttcaagatcctaggttatctaaattaggtttacgtgttatgtttaatgaatcccaaaaagtatttagtaacatagaatatgatgttggaaaatatgaagattatgaaatattgagaattaataatactgttccagattgtagaaaagatatgataaaaggaacctcatttcctttgcagttcaggatggcacaattccatgcgattgatttcaataaaggttgttatatagggcaagaaactgtagcacgtatgtatcgtgctggagtgaagaaaaatatatatactataatttctgaacatcagtctttttgtgatacgaaagttatgtgtgctcagcaggaaataggtagattattgtctaatgttggtaatataggattatgtttgttggatattagttcagagcatgatttttgcaatttaaaaattggtggtgctaaagttaaaatactacttaattaatataggtctttatctaatttctttttacttaagatgtataactttcgaattatcctgttgcagtgtgaataacttttattttttaggctattctatgattctgttctaagtaaatatgctagttactgattactgaattttttgttatagaaatttcttatgtataagttaactgtaatttttataggaaatgttatatttattttactatagaagtgagctggttttgtaagattattctcctataagaatgtgtatatagtgtagatcacttttatctttcaacatcttttatgttagggcggtaattttcattcaaaatatgataactttataagtaaagagttatttattatggttttacgacaatagtacatgtgtttgactgttgaagactgtaaactttatttttcaatatcacacttattctatttttcctattggataatccccagtaaaacaggcatcacagtattgaggtatactattattacgttttgtgttgcatattgccttgtagagaccatctatacttaaaaagtgtagactatcgcaaccaagagcatttttgatctctaactgtgataacctgttagctattaattttgattcttctggagtgtctattccataaaagcaagaatttatagttggtgggctagaaattcttaaatgtatttgttgaactcctgctttgtgtagtagtgttattatactttttagtgttgtgcctctaactaggctatcatctattaaaactattaccttgtcttttagtatggaagaattagcattgtgttttaacttcactcccatactacgaatgtgatcgttgggttggataaaagttcttccaatataatggttcctaataatgccaaattcaaaaggtatttttgtgtattctgcgaaccccaatgcagctggtactcccgaatctggtactggtactatcatgtgtgtatcttttggaataggattttctattgctaattctttacctatgtttttgcgtatttcatatatagacttattgtctattatactatctggtcgtgcaaaatatacgtattcaaaaatacaaaaacttgatttttgttttttaaatggaaaagaacttgttaaagtgttaccttggtcaattgtgatgaattctcctggtaatacatctcttataaattgggctccaactatatctagagcacaagtttctgaagctacaatatatgaattatctaacatacctaatactagtggtctaattccagctggatcgcgacaacatattatagtaccgtttattaatataactaaagaatatgcgcccttaatggtttttaatgcattaataacattgtccaagagagtattctcagtattaatagcaattaggtgagcaatgacttctgtatcgatatctgatgaaaatatacatcccctttcagtaagtgattttcttatttgtgctgcattagtgaggttaccattgtgtgctattgctaatttcccaaatttacaatctaaggttattggttgaacaccaactttacttccacttgtagaataacgtatatgtccaattgcagtgtttcctagtaaagagtctatttttgattgttgattgaatatgctgttgacttgttcatttgaatagtgaaaatgaagtttgttatcttctgacgttactatgccaaatgattcttggcctctatgttgaagtgcatgtagccctaggatgcaattaatagcagcacaattattattttgtatggcaaatactccgcattcttcatatatttcattaaactgcatagttagtcgagaatagaactattagctaatattctagcatagaaatacagaaattttaataaattatctgtgattattatgcttgtcatagtattgttatataagtagtaaaatttttaggatataaagatattttaggtgtgaaatattgacagtgtagctatacattataaatgaacttaagggattattgatagtttggatcatgtgttttcaatcctccactacatttaataaagctatcaaaaacaaaaatataaatcatgtaatatatcaaaaagttattgcaacattacaaaatgaaaataggatacaagtatcatttaatgatgcactgtttacaaattataactctagatctcctgaaaatactggtattcttgccttactaatattgataggacgtcatagtattatgtaatgcctattctgttggaatatcttcatattttataaggtttttgactttctccataaacattgaaggttttttttctaaaagtaatgtgatatgttctactatgttgagtatagtgttattgactgctttaatgttatggaattgtgataggacataatatgatagatctatcttgagatttgttttatttatgggacgaccaatgccaaaccttactctccaatagtctttaccaagtagattatcaattgatttgagaccattgtgtccagcattgccaccacttttttttactcttatggtacaaaagtttatttctacttcatcatgaaaaattattatgttatctaatggaatcttgtatagactggctatactcatgataggagcacctgaattgttcataaacgtccaaggtttaacaagaataactctgtgtgatttaatattcccaattgatatcagtgcattatgcctttctctgaagcttggaaagtaaaactcacttgctattgcatctacaatcataaatccagcattgtgacggcttagctcatactttttaccaggattacctaacccagctaacaggtaaaacataagagtttaagtcactaactttctgatgatggagtagtacttgtagactcttgattactttcagcttctttttctgtacttgcactagagattgttactattgctggattatgctctttcatagtcacattcacctctggaggaagttttaaatcgcttacatgtatagaatgtcctgtagttagaccagataaatctatttctatattttgcaatatagctttaggggaacactttatagataaagtacgatgtaatatgtttaatactccacccctcttaatgcctatacatttttgttcatttgtaaatattaaaggcacttctatttttatttctgtaccataatcaataaactggaaatctacatgttgtattctatcagttactgggtgcttttgtacatcacgcattaatacatattctttcttgttatctatttcaagttcaatcaagtgagttgacaatgcagcagatctatatttgcttacaaactctctattagataaagatatgctaagggaatcacgacctttaccgtatattactgctggtatttctccgctaagtcttagtgcacgtgaagggcctgtgcctacatttttccttaaacttgcattaattttaactatgccttgatctgtcattaaaaaatccttttgaaaacttttttgatttaatacttctgaatcttatattcttaccatattaagatgatattgcaatataaaaattgctatgttagatatttgaatttttagtggcaatttatcaaatgtatagtttgtgtagtgaaaaattaataattctaaggctcacatattcgaagagtgatttatatttaattaatgctataggatggtgattttttgtatacgaagataaacataagtagaaaaatcttatattactagtgagtagatgttaattacaaaaacatggaattttgttaaactgtgaaatggaataagtaataaaaattggataaagtgatttttactataagatgtataggtttagcttataaaattgttatagtgttctagctaatgtaataactctaacttcttttgcgcctgattcaatgagtttatgtgtacaggtcctgactgttattccggttgtgatgacatcatcaacaagtagtataattttattattaattaaatgttgattttttactgtaaaagattttgtaatattcttttctctcattttactagatagattatattgtgggattgtatctacgatcctttccaatacaaaagtttctataggtatattacaatatttacttagggccctagcaaggagagtagcttgattatattttctttgtcgtaacctttttttatgtacaggtatgggtattatagtagtaacattgttaaataaatctggattctgattgtacatccacttcccataagttttgacatgtaatgtattgtcagagaatttcagatttagaatcatatttttactgtgcttattgtatgaaaatacagattctaattttgtaaattttggtggattaggcacacactttccacatattgatactttatttggtagactacacccacatgcaatgcaatagttgtcacataaaaaatttatattacttttacatgtactgcataagtcgtggttagaagaaattacacattcacaatttgcgcatgtcttaggaaaaattatgttaaaaattttccctagcacttagctactgagatatattaaaaaactgctttatgaactcttcgtatatgttagccagtttgtttatgtcatctacagatgtattttcgtttattttatgtgcggtatcattttttaatcctagctcaatcacaggacaaaaatcttttataaaccttgcatctgatgtgccaccagatgtacttattactgcagtttccccagttgtcttttttatggctgcagatagcatatcagaatatttgtcagggtaattaatgaatggatctccagataatgatgtaaatatttggtatttttgtgttgtttcagcacaaatattgttgattatattaaataatgattcagaggtgtgtatattattatatctaatgttaagatgagcggtaactgtgcctggaataacgttatttgctgtatttcccacatcaacagatgtaatttcgcaatttgaaggttgaaaatattcattcccttcatcgagaactgtattgtttattttatgtaaaatgttgatcatatcatttattggattttgtgcaaggtgtggataggcaacatgcccttgtacaccattacacactatcttgaaattgattgaccctctacgacctatttttatagtatctcctacagaggatttacttgttggttctccaactaaacagtaatcaatttttttattattatcggttagccatttcaatattgcaggtgtcccatatttaaaatggttaccttcttcatctccagaaatcattagactaatagcaccatttacttgattgaaatctattcttgatactgctgctatgaaggcgcatatggcagatttcatatcaacagctccacgcccatatagaatgttatcttctatgtgcccagaaaaagggtcaaatttccatttttctaagtctcctgttgggactacatctgtatgtcctgcaaaacatagattaggatgaccatttcctaattgtgcatataaattacatacttgcacttcatcatttccaaaagttaaaacattacatgtgaatccatattgtgatagagtgtttgatagaaagtctatggcaccgttatctgttggagtaatgctagggaaggatattaattcttgggataatattactgggtcaatagccatagataaacctatatagaatatatatttattgtattcttgttgtaatacactgtcaatattactacttcgtagtttaggtcgttgtaaatgttgctatgattttgtatgtagttataaactactctttaataatatgctgattattggtttgtttatatatagataactcaatttttatgtagtgaaatataattatattttactctttaaattatattagttgttgaattattatgtaacatttgttggtttgtgtggcagaggttgtggtggacattgtgttatatggaatggcttatagttttatatgctctaacttttacattagaattaactgttaagttattatatgtaagtggttagttatgctttattcaaaacatatattacaagcttttttgagagttgtgtagggtatcgttattctcattctaaatcagattattcatcttctttattttttacagcatcataatttaccattctaaatctgtctttcaataaagaaatagcatggttactaaacccgttgttactcaatgctacagcacctaattgtaatcctacttcatatgtttcagggattaaatagtgagctccaagctctttgtatatttcaacattgcttaagtcaggcaaccttacgatgattattatatgtggaaagttctttgcaacaagggaaataatcttttttatagtaacttcgttgttgattgctatgatgatcattctagctcgtgatattgccatagactgtaaagtatttagttttgtcaaatccccgaggtatacagggaatccttcgtctattccatctttaacaatttttggttgaatgtcagatgcaatatagtttacgtgttctgcaactagtacttttgcaaccatgcgtcctactctgccgaaacctactactataacgtgttggtctaagtcttttgtatctaagataagctcttgagaatttaaagatattttctttttagtaattaattttgatatccaatcccctaatgttgccagtaatggggtgaaagccatagtaactgttgttatcatcatgagagtttgcgctaggtcgctggatagtacgtttttttctgctgcaagaccaaataagataaaagcaaattctccaccttgagataataataacccagcctgtattgctgctgcaagttgaaatctaaagaacctgcataatataaaaattataaaagatttgagtgctatgagagatatagaggctaatgttattatagggagtttattcagtacaaacttaatgtcaattgacattcctactgtcatgaagaacaaccctagtaatagccttttaaatgggaggacaacttgttctacgtcatgtctatactcagtttctgcaacaagaagtcctgaaacgaatgctcccagtgccattgataaattaaagttttctgtaataaaagctgctcctaaaacaatcaacaatgtcgtggctatgaaaatttcattgcttttcattgctgcaatagtattgaatagaggtctaagcaataacctccctgtgatgaagattaaagttaaggcaattgctgcttttacaaaagagtataatagtgatatggggatactatgatgtgattcccctgttaacagtggtaataatacaattaatggtacaactgcaaaatcttgtaataataaaactgctattgatagtctaccaacttgagtagattgatatcctttttcttgtaatacttgtagtactattgctgttgaagaaagggctagggctcctcctataataatagatcctttggaatctacaccaaactgacttgaaatataccatattgctaatgctgttactatgacctgtaatgtcccaaagccaaagacatgcaatcgcatggcaattaatctttcaaatgtgagctcaatacctattagaaatagtagaaaaactactccaaattctccgagattctgtataatgacagatgattctactaaatttaaaccatttgatccaataagggttcctgcaacgaaatatcctaatacgggactaatattcaacttccaaaatagtacaactattactatggctgctgaaaggagtgtgatgatgtctagtaaatacttggaatcgtgcatagaaagctcttaattaggttacaaacttataatcctgagacttccactttatggagcaaccaatacttggtttttgattttcaggtgattcacctgtttttgaaattaatttcatagcattaaataaatctctgtcttcttgtttactgttcatctggtttttccctgaagcatcaaatcttcctctatagcacaattctaatttattgttaaatccgaaaaaatcaggtgtacacacagcaccataattccttgcaactgtttggttttcgtctattagatatgggaagtcaatactatgttcttgtgcaaaattgatcatattatcaaatgaatcttccggataagtaatagtatcatttggcataattgctacagtgtaaatattataatcgttctttaatgtgttcacatcatacaccagattgtttattattgccttaacataaggacagtgattacatataaacattatcaataaaccattacctttatgacagctgcttaggttgtataaattgccatctatagatttcaataaaaagtctttagcgataaactttttatttaccggaggggtattaagcgctaccataactatatttctcaaactataaacaacaaaactttatgcactactttattctaaaatacaatcttttaaagtcaaatttaattatactgaatttgcgaaaattacataaaaggttttactacaaccataatcacaataactattattagtagagttacagactcattcagacatttaaagtataataaggacttagtgttgctttttgtgacaaaatctcttctatgtttaaatagcatcatatgtattatacacattaatataacacatgttacttttatcttaaaccataagaagtgatatgcttctgtcataaaagctaaaattacaccaagaactatactagaaatcatggatgggttaattatatagaataataaccttttttccatagtattaagtaaactatagctatcagaatgtagagcaacttgcacgtgatatacgtataatctgggcagatatagcataccagccatccaagtaataattgatattatgtggaacgcttcaacccaatgttcatagtctatcattgtaggaaccagtatatgaaaacccttctaagtatacattatatgtaatattcttcagaatacaattagaatatttataataaatgtgtaagtttttatattatttcataacatcatgactttttcaatgaatacatttaagaatagtttttgaatgtttatattgttcaaaaggtaagtgatattttgtttaaaatgttgatgcaagtttttaataataaactatattgctaaaatatttttaatatgcttattaaatgcaaatttatgtgtttgggtaaagagttttgtttaataaaattgctataataaacttaaaatataattattgtagattatgactaaaatatcaatagttatataaaagcactgattaaaaacacaagatttattgtgtggtttattatgataaggtatatttgttatgagtccaatgactctaatgtttgaatccagttataaatatgaaagaacttggaatattttaaagtgttaaagattctgatagtcataattatctataattgcgaatacataaagcacgtgctgcttctagtatatcttcaatttgtggtaatgctaacttttcaaggtttgtagcataaggtaatggtacatcttttccagttattcttatcattggtgcatctaaatcatcaaatgcatattccattatcaatgctgctatttcagatcctatgcctgaatatggccatccttcttctatgctaataattttgtttgtttttttaatagaacgtaatattgtttctgtatcaagagggcgtagcgttcttaagtctataacctctgcatttataccttcttttgctaaaagttctgctgcttctagtgcgaatttaacttgtagggaaaacgctgttattgtgatatcagttccttccttgactatagctgctttcccaatttcggttatatagtctgatgttgatacttcatttggtatttcatgcttatgtccatatgcgatctcattttcaagaaatacaacaggatttaaatcccttatagctgcctttaatagacctttacaatctgctgcaaaatatggggatactacttttaatccagggatgtgtgcataccatgaagcataacattgagaatgttgtgctcctactcttgctgctgcaccattggggcctctaaatacaataggacagttcaattgtcctccagacatgtaactagttttagctgctgagttaataatttgatctattgcctgcatagcaaagttgaaagtcatgaattctacaataggtttcagtcccgcaaatgcagcacctacccctatcccagcaaatccatgttcagttatgggagtatctatgactctatcagggccaaattgttcaagtaatccttgggtcactttgtatgcaccttgatattcacctacttcttctcccataattagtactgtatggtcgcgttccatttcttcacgtattgcttcgcatagtgcttctcgtacagttaaagttctcataatttggcaatcttgataacaatcttgaataaattatatgtaaaaaaacacatatgcaaatacaatttactaacttgtatttattttactaggatgaagcgtaaaaaagttaagactaatagaatttactctgagttatatgtaatacatattctgctatgttaagtaattaatttttattatcaataaatttaatcctagtagtttaattaatatacttgagctattttatttattagatgtggtagattgtgggtatattttacgatatgaaagttgaagtaaacgtataatacattttctgtgttgtttattaataattaaaaatgatgaagagttttcagttagtatgacttgtataataatacatggtgtgtaccagtgattgcatattgaaaaatggtttggagtttgtaattatcacaaaatagctaagatataagtatataatgctatagaataaagaatctagtatgtattagttgtatttcctaggaagtatatgttcctggcatatttcttgttgctgctatgtctgttgggttgcttacagtagtttcaacaaggttgttaggtgttttaatatgatagtacaacatagcccctataaatgctattgcagcaatacaaaaaatactaattactgttattgattttatattttccatctcgctactaacataacaccgaagaggaaataaaactcctataatgctacatattgtcaatgtgctgatagttatgtatgcaataatgagatttctttttgagtgctgtatatttgttgacctatatatttgtgtacgttttacaggttttatagtttttcttaatgcagatatgtcttcttgtattcttgctatgtaactattgtcttggacaatagatggtagaaattcccgttgtctttgtatgtctggttctatagttgatgatgtagcacctgaagtagaagcttgtacctgactaagtgttggagtggtagtagatagtgatgtatcctctgttgttggtgtaatgtcatctgaaataggggttagaggctgtatttgactaggtcttgaagtggtaggatgtgatagtaagtctgttgtttgtagttgtgttgtggtctgtaagcttggttgtgatgtgtgtttcgtgagtttgtgtcttgttattaattcaggatgttgtgtagattcaggagtagttatttgatcatcttgtgtagcaaaagatattgaatttactgtacttatttgttgtgatatattctgactgggaattatatgtaaatatatatcgtatgaattgaggcatgctttaactatatccgaagtgttctttttggaaaatgctctggaaacagaatggtaagatatgttacatacagtgcataataattttttgatgttagtatgagtgttaagatctggaaattcgaaccttggttctagtgtagtgttatgtgtaatagttatatctttttttaatgaaaattctagtgatagtgctaggtgttgcgtaccgtataaggtactaaaagtaaatatatagttgtgtatttgattacaaaacgtttcttctgttaaattatggcaagtgattttataagttactgcatcgctggatgctgttggttgtttgtgacatgttaaagaacattcttgagggtcgggtaatgtgttaaatgcttgagaatcgattttgtatattgtaaagagatctagataattatattgagtgctgcataatcgtttaataaagtctgtagctgatgttctacattgtggatcagatgttgttatgcatgctgatattgatgcgttggattttttattttgtgggtctttaacatgaatcacagctagcttcaagtcttttggttgagaatcaggaattaatgtagttgttggtgagttattgtataactctatgatagaataaagtttgtatattccctttacagtaggtaaattagtagctaggttattgtttaatgtatttatgtcgaatggtatattaaatattgtatcaaaagataaagttaattgttgattcagtcctattataggatgtttactgagttcattagatagaaggctgctaataatagatttcaatgcacttgtaattgttattttatcaaaagaagtttgtgataaaattgtagatggtagtattgtttcgctttctgttgtattgttgacacgtattttaaagtgtaacggttgttgtgttagtgatggcgcgtcaccagctgaatttgaataatatggaagaataaaattttttgtaacataaaattctaaaaagttgcacaaagcttgcgaaattctacttatagtaataggcttgttctcttctacatgatgtaatgtgtaagatattttcagtgagtcttgatgtactttgtgtgatatattatgtgaaaattctgggagaattgattcccctagtgctgcgataacgatactattgtctggattgatagtgttagattcttgtaattctggagatgtaagcatataaactgattataagttataaaaaagcaagtgcccgaaagaagagttgaacttccacaatcgtaataattactagcacctgaagctagcgcgtctaccattccgccattcgggcatatagtagttgatttattaacaattatactataacatgttaattttatcaaattaaatctgtatggttatgaatatctccaatgtagaacagatgcttcttgctcataatcaagttaatgagagtactgtgaatcgtattgttcgtgattgtttgtgtgtggcggatggtggtgaattgtttctagaaatgtgtgtgtcagaatcccttggactggaaaatggaattttaaagtatgcagattttaattcacatcaggggtttggtttgagatccttttgtaaggaattgacagcttttgtttgttcttctgaaattactgagcaagaaatagaaaatgctgcagctttagtaaaatctattaataatagtaatagtgggggaattgtacatttaaataaggcaaaacctattttatatcctgagactaatcctttacagaagatggattttgatcttaaagtgaagcttctacaacaagttgatgattatttacatagtaaaagtccatatgtaaggcaagtaaaaagttctttaagtggtcaatggcaaatagtttatattattttacctactggtgatagagtttatgatgtgagaccgcttataagatttaatgtgtgtgttattttagaaaaagatggaagaaaggagagtggttcttcaggtcatggtggtagagcttcttatgaggagtttattggtgatggtaaatggcagatggtggctgatgaagcattacgtcaagcgttagttaacttggaatcggttcctactcctgctggtgaaatgacagtagttttaggccctggatggccaggagtattattgcatgaagctgtaggtcatgggttggaaggggattttaatagaaagaaagtttctgccttctcaacttctataggtaagaaagtagcggcgaaaggtgtgactgttgttgatgatggtactataccgggacgtagaggttctattaatatagatgatgagggtgtatcttcagggtataatgtattgattcaagatggaatcttagtgaattatatgcaagatagaatgaatgctaaccttatgggtactacttctactggtaatggtcgtagacaaagttatcaagatgttgtgatgccaagaatgacaaatacatacatgttgccaggtagttattgtccagaggaaataattgcaagtgttaaaaaaggtgtatatgcagttcacttttccggaggacaagtagatattacatctggaaagtttgtattttcagcttctgaaggttatttgatagaagatggaaaggtaacatgtcctgttaagggtgctacaattataggtaatggtcctgatgttttgacaaaagtatcaatggttggagatgacttaaaacttgatcctggaattggtacttgttctaagaatggacaagatgtacctgttggagtagggcagccaactcttaaaatagacagtattattgttggtggtacagaagtttaatttaaaagatctgtttacagttgtatacaatattagttcgagtaaattactagtatggggattgtattattaacatgttgttactaaaaaagacagatttatcaaagtcaagaaaaaatcataagtactaatatagtaatgttgttagaagaaatagaaataatgtaatatgttaatgattggcaaaaatagaatgaacaattgctatggaaggtgcaatgtgggatgtataatatacaatttagaagaaaagaataaaaggttattacaacagtattggaagtatagcataatagtataaggttatgtaaatagggtactaattaaagaacatagggaaaattgtgtatattaatttcatagtgttagggggtgtagaataaacatttatttattatgcctaaagtgtattatatctccatcttgtacgatataatctctgccttcaaacctgacttttccagcttctttgcactttgcctctccattgtattttatatagtcatcaaaactaatgagctctgcttttatgaaccctttttcaaagtcagtgtgtattacgcctgcagcactgctagcagtagagaatctttttattggccaggcacgtgcttcttgtggacctaatgtaaaaaatgtaatcatatctagcagatcatacattgtttttactacagatgttgtaccagattcttgtaaattaaactcagctagaaaaatttgtttttcttcttctgtttctaaacttgatacatctgcttctaattttgctgaaatacaacaaaacttattatgttttttttctgccataagttttactttttctgataaagcatttccagtggttacattcgattcttctacattacatacgtacatcataggttttgttgtaatgagttgtagttgttttaaatcatcgcctaggtgttttgcactttttgctaaattgccagcttctagcacacttaatacttctaatatagtatctaatttctttctgggttctttattagcttttacagctttttctgttgcaggtaagcgacgttttaaactttcaatatcagctaaaatcagctccatttctacaatttctgcatcacttattgggtctacagtttggttaacatggctaatgttttgatctccgaaacatcgtaatacatgaataatagcatccacttctcttatatgacttaagaatttatttcctaatccttcaccttgacttgctccactgaccaatccagcaatatcgacacattcaacttggttgtatataattttcttagaagatgctatgtttgctaaagtttttaacctatgatcttgtactattgctttgcctatatttggttctattgtacagaatgggtagtttgctacttctgctaccatagtttgtgttaatgcattaaatagagttgattttcctacattaggtagtccaacaataccgcagttcaatcccataataatgatcagtaattgtaaaattaggattgtatcattaattacttacttgtgatacttataaattaaataagaaagtgtttatatgtttgtgtagagttgattttcctacattaggtagtccaacaataccgcagttcaatcccataataatgatcagtaattgtaaaattaggattgtatcattaattacttacttgtgatacttataaattaaataagaaagtgtttatatgtttgtgtagagttgattttcctacattaggtagtccaacaataccgcagttcaaccccataacaatgatcagtaattgtaaaattaggattatatcattaattacttgcttgtgatgctcttgtgatacttataaattaagtgagaaagtgtttatatgtttgtagtgtagagttgattttcctacattaggtagtccaacaataccgcagtttaaccccataataatgatcagtaattgtaaaattaggattgtatcattaattacttgcttgtgatgctcttgtgatacttataaattaagtgagaaagtgtttatatgtttatagtgtatttataacatatttgaaaagttagggagaatctatatagtatttattataaattcttattatttgttcagtattatcagttgttagatattagtgtctgtatttatgaattttacttaggttgtaaattaacatgaatatatgtgttattaatattgttacgtgttggatatgatataaatgtattttatttaatgctgatcaagaaccagtgctaatactagttttgtaagcagcatagaactatggcttgagcagctattccttcttttctaccaagaaatcctagtttttctgtggttgttgctttcacgttaatgcacgatggatctatgcatataagattagcaatgtattcttgcatttctaatgcgtgtggcataatttttggttgttcacatataatagttatatcggcatttgaaatagaatatcctttctcttgtgcctttttttgtgcttctattaaaaagtaatcagatttaatatttttccatgtattgtctgtgtttggaaagtgttggcctatactaccacatcctactgctcctagtatagcatctgttaatgcatgtagccctacatctccatctgagtgagcaataatctttttatggtagttgatttttattccgcatattgtgataaatgtattagcatcattatagcatgtattatcaaatttgtgtacatcgtagcctattccgaccttaaatattggtttattgggatgttgattcatagaacagttttatttcaataaaaagcgagctggtatttttatactgtatttttataggaatggatatacgttgtttaagtgcattgtttaataattgtgatctatatgtttggtatataagattgctctatgtaaatcttctatagttgtaattttaaaattgttgtaatctccttcagttgtcattattggtatgttgtaatgtatcataagagatgattcatctggaaattctctgttgggttcagtattatatgcaattctatgatgtagtagtatttcgctatatttatatgcttgtggtgtttggattaatttaatactgttcctgtcaacattttgaataacagtcttgttttcatgtactacatgaatagtatcggttattgaaagtactggaacaacccctgcataatgagttagtattgattccattgtatctaatatctttaaatctataaatgggcgacatgcatcatgtattatgacaaaatatggatttatattttgaatgctctctaatcccatacgtacagaatcctgtcttctttttcctccataggtaggaggtaatagtttatcattttgtattttttgtaagcaattatcatataaatgttggtgctcttttctaatgactactttgacgtaattaatcttaggatgtgagatcatattattaattgtactgcaaagtatattatgattacctaatgaacaatattgtttaggaatagcactccatttaaatctattactgttaccagctgcaacaattaacagtgtgaacttgtgcataaatttttgtatggcatgatcttaactaagattatcattttaaaagtcttatcgtaattgtacaacataaatgttctatggtttagtgcactaattaagatcagtggcgtatttagttgttagttaaaattcaatgcttgtaataattaataattttgatataataaattaatatttttattctatttaataaagtaaaaatattatattaatatttatggcactaaattgtaattgtatatgataggtggaaatactcaaactcctaatgactatgttcctataagaaggcatcaactttctcataatagtataaagtcgttaacaaagaaattatttttgttaaatactagtataggtattgtgtctgtaattcatgcatcatttttaataatgttgtttgatgctatgtgtttacagaaaaagcctaagcatactatcttaacattagcagctttaatagctgtaatctctgttgtatctctgttgttattctatgttagatatacagtcagtaagaagaataaaagacatcttgaatcaatgcatgcaaatgctgagtcttttgtatctttactacaggaccgtcaattgttggataatttatcccataaagttcatcacttacaacatttagcacatgagttggaatccatagatgagaaaggtgtatttattgagcatgcttctcagagaatatctgcttctagggttgatgttgagaaacaattgcgaaattttgttaagcattgtgaggatgatatatctaaaatgtatagggaattagagggtgtgactgttgatatgtctgaagtgagtggaatattacttaatcctagtttttttaaagagaatgaagcagggttgatgtctctatctgaaagacgtaagttaatgagtcaaaaagaacatgaaattaatctcctgatgaagggttactgtagtgaaatattagctaaaatagtatgtattattgagatgatgaagttacatcagtcttcttctgtagaaaataaaaaggtttctctttttagtgaagatgatagtaaagtgaaagaattaatccgtattttggttaatactaaatgtgtcttagaagaattggatggtgaagagataaaatatcctacatttgaaatgttatgtaatgttatgtggaatataggttcttttttatcaagtatgcgatgtatggcaaaggagagtgtatataaaaaagctgaaaatttaattcaagaaaaaggtaaacaagtacagagatttatttcaggtatattatctgctgttcgtaaacttgatgtagtaaaacaagaacaaggaagcgaagcaacttcatctgaacatactatgtcagaggaggattctattgtggctttacggttagtgcaattgcaaagtataattttaaaattgttgtttattatgcaacggaataaatcatatgacattcatacagaaacttgcagtgaaaattcaaatgggcctattgatagtgaagagaatcctgattttgctgtccagaacttgcagagtgtatcatgttctggtataatgttaacataatgtactgtatttttgctatttttttcattatctagaaataatgtattttaatttttattaataattgtgaagtaatatgctaattgatcaaaaatttcaacacttaagtcaggcttttaatagttattctacactttatcagcgtaataagttgaagtcaaagtataactttttattaggcagtagtatatatttaactgcgctagtgagtgtattctctattgtggcattgtatcaccatagtggatgctttaattcaatatttagtggaaaagacaaattatttggtgggaatatacctgttgttttttcaatagcattaattgttgctataccatcttttatattgttgttctttttaatttataagatatgtgcaactcaggatataacggatcacgttgtagagaggactaatgatcttatagggtctgctagagaagtttgtgagtttttgaaagagaagttacatgaaaatacgtgtcaagttgaggcgttggtaggtcattacggaagtttagcggctaaacatgatgattttgtgaaaaaatgtagtcgttgcctacaatctctagaagaacagcaggtagcacttggtgcattggttcgtaggtctacaagtgttgtagataataacatttcagaggtacaagctctagttgtagatttaaaagcaaagatagctgaaatgtctgttgctcatgtgaagttaatggatgcatcagaggatgttagggagttcatcgtaaagcaactgagattagaaggtttgggtttacagcatagagtgcgctttctcgacggtttacaaggtactttatcgcagaatattgatgtaagtgatgcaaaatctgcgatgaaaattattatagaaagaatagaaaatgagataccaaaagtaaggtttgcgtttaatagtcttaatagcatgttatggagtttacatagtaatttattaaaagcattgttaggtctagataaagatagcagtcctgatggatgtattactgtttgtcaggaattagtaaatgcattgcataaattcttgggtgatatgagagctaaaatagacaattataatggttctgataaaagacagtttgttaatattggattagtagaagtaccattattacaaataatgatactgcgtttgatggctacaaaacgtgcctgtatgtttgaagatgtgtgcgcatctgttaaagattttattgaaagtggaactgctgatagaagtagtagtacaggaacaaaggttattcctgattctgcagcctctgcagctgcacctgtaacacctacagcatctgtaacacctgcagcatctgtaacgcctgcaacacctacaacacctgcagcatctgtaacacctatagcatctgcaacgcctgcaacacctgcagcatctgtaacacctgcagcatctgtaacacctacagcatctgcaacacctgcgacacctgcagctggtactaatgatggtgcagaatttgcaacacctcctatgggtactactgatgctccgagtgtggaagatctgagtgctttaggtgctgtaggtggtgttgatcctaatgcacatacacataccccgtagatgtgtatcataggtattgatggggtaaatatgtttgttaaggtttgtgatctattttaagtatagaactgaactgtttgtatggactttttatatgttgctacgttgcattgtactttttatgtagccttatacaaaggtgtataacttattttacagtataaaagtctgcatgctttaataaaacttatagcggtatatctggaattaattttactgaatcagacaagttctttctccatatttttaagttttttctgatttcatcattttctaaggatagaatagatgctgccattatggctgcattgtatcctcctgatgatcctatggacattgttgctacaggtatacctttaggcatttgtactattgatagtaaactatctattccatttaaattactactttttacgggtactcctatgactggtatgtgtgttaaggatgctactaaccctggtaaatgagctgctcctcctgctcctgctataataactttaaaaccattgtcttctgcagattttgcaaatgtataaagcctttctggtgttctgtgagcagatatgatcattacttcatgagttatgtttagctcttttagtattgatattgagttgttcattgttgaaaaatctgattgacttcccataataacagcaacatctgcaatgtttttattggttgacatgatatttctctataatatctttaatggttgactttaactgtgatacactatttatattagttattgggttcatcccattgtacaaaactgctatatatgggatgtgatgatcaaaagttatacctttattagttaaatgtgacaatagttttttcatatgatttggtggtacattatatggagtaaaatatagagtaccttgtttagataagaaggataacaacttatttttattttcatctaacgagataataataggatgaatattttcattattagcaatgactttgttaatttctggaagcttttttatacaactgctacaccaagatgtataaattactaaaatatttacctttgaatctttgattgtgaacatctcagataatgctttgtctgaatttatttctttgatttgtaatagcgtatctggcatattacgttgtatttgatagtaggaagatatcttgttgatagtaagtagaataaataaaaaaataatacaagtaaaaaatataaagtgtttgttattcataaaatttacctatttgtgtttttatgggttctttaacaggtacttagagtgttactatatattgtgttgttgcttactaaaagataattttaacctgtagggattatttttaagctgtagtttaaagtagtttaatgtctttgtaaatttgtaaattaaatagatgtaaattaaaatagtcatgtaagaaagttaatgataagtggtgtatttttgtatgctgttataattttttgcatatgtgttgaatatatttagaatatagtcttgaacttttaatctaatgatatagaataaaaagcattaaattttaagttatttataatatgactcaaactcttactaaatcgaagatagcagaagttattaatagagatgtagggttatctcgtgaggatgcttcgtctgttgttggggagattttggatgaaatgctgaatgcattggtaaaagatcgtatacttaaaatatcttcttttgggacttttaagtcttataaaaagaaggctcgtatgggtcgtaatccaaaaacttctgaggaatttgttattaaagagcgttatactgtgtcattttacccatcaatacttattaagcattcaattaatagtgatgatagtacagagtagaggtaaaattcatgggtgaaaagaaaatattacacgatgaatatagtagtaagcttaaaacaataggtgaggttgcaaaagacctggatgttgaacaatatgtactaaggttttgggaagaaaaatttcctcaggttaatccaattaaacgtcgtggtagaagattgtattcacaagttgatgttgatactttaaagcatattaagcatttattgtatgataagggatataagattaaaggtgtgcagcaagaattaggtaggaaacctgctaatattaataaacacactaatgatacagaacaaagtgtttatagaaaagatttaattagtttgctagatgatatgttaagcttaagggatagtttgttaaagaagtttaacggaatgtagcgcagcctggtttagcgtgtcagtctgggggactggaggtcgtgggttcaaatcccatcattccgaccaattaactctgtctttaatactatatgatctttagttcatattataagtggtacatgtgaagttatgttgataatatggttgtatacttgtaattttaattactttgttagttataaacgtgatttatataagtagttagtaataatgttctgaatataatggcatttatctaatatggtgtgtgcacaggtgttatagtatttttttgaagtgggttatttaataacattgttaaaatacattacagtttttatttagggttttttgaatacaagttataggtattataaaaagtaggggatacgtttaactacatataagaaggtgcggatggagtgggattcgaacccacggtacgctattaacgtacgtcagttttcaagactggtgccttaaaccgctcggccatccatccaatttatttgtaacataatattaaaaatcgtgcaatatctctttagtttgattgttaaaaattaagaatagtacaatatgttaatgagataatattaaatgagaaaaaacaggtaatggtatcacaaataaattatttagctaataataatgtttctttttttgtgcagggaaagttgatttaaaacaaaattaatacactaaattgtataattagagcatgctattttactaatggttattgtatgcttcatttaacaacagaaattaatgatattgatttctctaataatttaaatatttatagtgggaatagatttgttgttacaagtggtgacatgcaggttgatgttggaagtgaacctgatcatggttatcatattttatttaaaaacaatggtcatgttatatcagattttcgtggtgtacaagctgaaaactttgtatttgatataaaaaatcacaatttaagagcttctttcttagttgatcctatggcaccttttacagaattagataacagtcagcatccacacttcgtcgttaacatgcacactgcaaatgaatgtggttctgattgtgttcatcacaatgaacatgatcatgatgcacacggaagaggtgcggctagctctgtagctgaaggtgtaggttctgcaataagtcaaatcttatctttaagtgacagtatagtggttccagttcttgaaggaaatgctagtgtatctgaaggagatgcagtagtaaatgctgtaagccaagaagctcctgcagctagtgtatctgaaggagatgcagtagtaaatgctgtaagccaagaaactcctgcagctagtgtatctgaaggagatgcagtagtaaatgctgtaagccaagaaactcctgcagctagtgtatctgaaggagatgcagtagtaaatgctgtaagccaagaaactcctgcagctagtgtatctgaaggagatgcagtagtaaatgctgtaagccaagaaactcctgcagctagtgtatctgaaggagatgcagtagtaaatgctgtaagccaagaaactcctgcagctagtgtatctgaaggagatgcagtagtaaatgctgtaagccaagaaactcctgcaactcaaccacaatctagagattctttgttaaatgaagaagatatggctgctcaatttggtaatagatacttttatttctaaataaacccataatatagcatgttaatgctataaaactgtaaactgataatcaaggtttagcttctgtggtgatagaagttaaaccttggtatgttaataaaaacgttatagtcttataagtatactatttttgtatttatgtataatgtcaagtgatgatttaatcttttagttaatgaatacactttcttatttactttcattattacttgtattaattctaggaaataatactgtattatttgtatgatgaacttgaaattagagttttagtacatttcactttataagttttactgatattttttatcacgttgtgccttaagattataaagtataaagatagaaagttaagcattatgaatttaaaggttattcatctttttagattagttatcgttgtaaaaagcgatcttacaaatacactaagtttgtaatgataagttttgttttttatatagcagacggaaaccttataaactgttaactagtaatctgccaattttaagacgttaattaaaatcaggatattggccatcagataaaaattacacctgatagtgaatatagcacagtacatacttagcaacttttgttactagtagtaatgtgctgtattaaaattggttttttggttgattgatatatacctcactagcaatgctaggcatcatgttaaatagtaaatgacgtagtagtgtataaattaatcttttgctaacaaagtattatgattatgaccaacaccctatgatttcttttatttctaatatgtgcttattagcaatagatgctgctttattgttacctgatactattatgttatgaagatgttctttatcttcaaggaattctgttactttatgtcgtattggagcgatattatcaatgagtaattctgttaattgttccttgaattgttttgtactgaaattttcaatgttagtgcatgcttgttctatattgatgtttaaaagtgtagcatatatgctaacaaggtttttaacttcaggcctactatctaaagtactaaaattgaatcctactatagaatcagtggttgctttgcttattttttttgaaattacatcgttactatcatataagttaatacgagtgtaatccgatgagtcagatttactcatttttttctttccattcctcagattcataatctttgctgactcctgcataatcaatggttctgggatttgaaaatattgcgtgttatatgtagaattaaaattcatagcaatatccctagttagctcgagatgttgtttttggtcaatacctactggtacaatatttgctttgtatattaatatatccgcagccattaatactggatagctgtatagacctaaacaagctgttgatactttgttacggcttttttctttaaattgagtcattctatttaattgccctgttgaagtaatacaactaaatatccataacaattctgcatgtgcatggatggatgattgaacgaataaaactgatttatttgggtcaataccacatgctaaatatgttgctaatgtgtttatagaattttgctttaattcagctgaattataattattagatgttaaggtatgtaaatcagcaagaaaaaaaaagcacttatatgaactttgcaaagacacccaattacgtatagaacctaagtagtttccaagatgtataccaccgcttggttgtataccagataaaacaataggtatagacataattattatcctcaaataattggtggtgtattttacaataacttatctgattatgcacgtactttctacactgcaaaaacacgtaatatacaactgatattagtatgtgtcagaatagtagagagatgaatgtatgagagtttaattaaattatatctagtcactctttttagatataattactgaagctgcacgtaataatttgtcttttattatatacccaggttgtacaacatgtaagatggtgttgtcatctttttctgcgtcgaccatttgggatacagctttgtgaaactgaggattaaacttttctccgattgggtctattctagtgatgttgtgacgttctagagtgtttaacagttctttatatgtcatcagtactcctgcatgaatactgtcaccctcctttaagttttttaatgatgtttctaagttgtcacaagagcttaataaatcacgagcaaagttagaaattgcatatatggaagtatcatctatatttttttgcatgatgcgtttaacattttctttatcagcaactgctaaacggaattgattctggaaatgtattaattgttgtcttagcttgtctagttctgacaaatcttcgttcaatttttctttcttcttgtttattcctgctgtaaattttctttgtggattgacttgaggttgaccaggttgaaccttgccgtcagacttttcattgggttgagggttgttatgctgtggactttttgtattgttgtcaccattatcactcataattctgaacttgtttataaactctaagaaatatatagtaacattatgaaaaaatatcaagagttataagctttgttagtgtggtttttctgtgttgttaatattttatgatacgttacgataagaaatttatgtctttagcattaaggattgcaagacgtggtcttggtaatgtatttcctaatccggctgttggatgtattgtggtgaatcatggaatggtggtaggacgtggatatacacaagttggtggtaggccacatgcagaagttattgcattaaataatgctgggcatttagcaaaaggttctactgtatatgtaactcttgagccatgctcccattatgggcaaacaggcccttgtgcattaaagttaatagatgctggtgttaaacggatggtaatagctgctaaggatcctgatgtgcgtgtttctggaaatggtatagaattattacgtaatgcgggtatagatgtaaagtgtggtgtcatgtatgaagaggcacgagaattaaatattggttttttttatagtaaaatcaagaatagaccttttattacagtgaagttagcatctactttagatgggaaaatagcgttaaaagatggtaatagtcgatggattacaaatgagttaactcgtaattgggtacataaacagcgttctatgtatgatgcaattatggttggtagtaatactattgttcaagataatccaatgcttaatactaggcttcctggtttagagtgttattctccagtaaggatagtaattgatcgttttggtaaagtttgtgactatcataatatcataaaaacttctgatgttatccctacgtatattttgacaaatgatgttcctcaaacaaagttgggtaaagccagttgtttagtagttgatgataaagataattttttaagaagtgcgatgaaaatgctttctgtaaaaataggtattactcggttatttgttgaaggaggtggtgttttaattacagaattgcttaaaaatcagttgattgatagaattatatggtgtagatcaaataaaatttttggcaatgatgcaataccatctattggtgatttggatatcttgacactacagtgtggttataatttcagagcagtagatacattatattttaaggatgatattgtagaaattttagagcattgtaccgaataaaccgaataaatatactttaactgtgacatcttagtttaatagaactttatatttatatatgattaatatataatgataatggtatgtggttataactgcttattagttgatcatgtacctgtgtgttatgttaaatagggtataaatatgtcacaattctctgaagataatatgggtaatatacaaatgccttttgattctgattcacatgagccttctcatcttgagctacctagtctttctgaagaagtgattcaattagagagtgatctacaacaatcttctaattctgatttacacgggtctttttctgttgagttatttgatccttttaaagaagcagttcaattggggaatgatctacaacaatcttctgattctgatttacacgggtctttttctgttgagttatttgatccttctaaagaagaagttcaattggagagtgatctacaacaatcttctaattctgatttacacgagtcttcttttgttgagttacctggtccttccaaagaagaagttcaattcgaagatgatgctaaaaatgtagtatatggacaagaccatgttagtttatctgaattaggcttattgttaggtggtgtttttagtacaatgaattatttgtctggttatacaccgtattattatcatcattattgttgttataatccttattattattttgattatgttactccagattattgtcatcactgtagtgaaagtagtttagagtaggatatttagaaatataaatggttgttgacttcacaaaaggtgtagttttatatgttttatgctgttttatagtgttataaggatatgagttgtttttactatttttctctataacgtttcagtctttaaaaaacatgacttaatataaagcagcataagtattttagagagtaacttttttatagtagttgtttttttacttttatgtgagatctataattttaatgttttagttatagattgtatgatttgatgtgtagatcagtattttaatcgctttataattttttagttctgaaaataagaaactgctgtactgcatttataaatttttttctaataactgaatacaattttagttaatgatatagatgtgtagaaaaagaaatttcattaaatactaaagctcaatagactatgtaattctgaagttgactattcttttttagtctaatgaagctttgatgaatgatataaacaatggatgagaatgaaaaggacttgatttaaattctggatggaactgtactccgataaaccatggatgatctttcagttctataacttctattaaactatcattgttattatttgatttgcctgtaaagattaacccatgttgttcgagtaaatctttatactgtaaattaaatgcatatctatgtcttcttctctcatgtattattgattgctgatatatggaaaagattttagaacctgattctaaataacatggacatgaacctaatttcatgcttccgcctaagaaattttgctgtaattctggcaattggtgtattacaggattcttgcaatataagttaaattctgtggaattagcatcttctaaatgtgccacattatttgcaaattcaattatagcaagctgcattcccatacaaatacctagaaatggtatcttattgagacgtgcataggttattgctgtcatctttccttgaatcccatcatcaccaaatcctccaggtattaatatagaatcaactttgtcgaaaatatttatctcattactatctagtgaacgtgaatctatccattttattgataactttaccttgttatggattgatgcatgttctagagcttcaattaatgacttataagcatcaagtagttttatgtactttcctattattgctacatttactgtttttgttactgcgtgagaaatatttagtatattttcccacttacgtagatctggttcaggtgaatcaatattaaaatggtttaatatctgtgtgtctaaattgtagttgtgataagagatagggagttcatatatatttttaacgtctaatgcaggaataatatttgttgatgaaacgttgcataaatttgcgatcttatctctttgttcttttgataaaggtattttactacgatagagtattatatctggttgtatgcctacagaacttagttctttcacagagtgttgggtaggctttgtttttagttccattgctgcgtcaatgtatggaactaaagttaaatgaacaaatatagtgttatttttactgagtttgtaaccaatttgtcttatagattcaagaaatggctggctttcaatatcccctacagttccacctatttcgcatataacgaaatctaatttatcagtatcatgtaaaatgaaagaattaatgagatcggtaacatgagggatgatctgtactgtttgtcctagataatctcctcttctttctttctttagcaaattatgatataccttaccagtagttatgttatcgtttttcgttgttttaactccagtaaaacgttcatagtgccctaaatctaagtctgtttctgctccatcatcagtaacaaaaacttcaccatgttgaattggactcattgttccaggatctatgttgagataagggtctaacttccttaaacaaatcttaaaccctctagcttgtaatagtgcacctatactagctgcagctaatccttttcctagagaagataccacacctccagtaacaaagataaacctagttgaagcttgattcatataccttactgattaaatggtacgctatcttcattattatgttccatagggggtaggttatgtgccttactcatctcggcaatttttttaacaatagactccttgtgtacgcttttagcgtttatgcccactaatagaactgtgttgataataaaagcagtagcaataataactgtgagttttgtaataaaattagaagatgatccagttgtaaacattgagtctaaattactttgtgtgcttccaaacccacttaagttgtcagattctggtggttgtaataatataagaatcaccaagaaaaatactaagactaattgtataactgttaaaaccatatagaaacaataacgctattaagtacatacataattgggttatacattgtttattgtttaaagtcaaggattgcagaagttataaaaaatataatttttatactaacaaattaaaaatggatgcttattaattgaatttttatagagtacagtatgtctgatttgcagattttaactgagcatgtatttattcttgtagagaattaataatcatgaagagattgttgcattatttgtaatagcaatagatttgttatgtgttagaattcgaggatatgcaaatgattagttagtatggataatcaaagatatgtaaatatttttcttgaagcgatagtagcagaaaaacatgtatctcataatacttatcagagttacaggactgatttactgggactctgcaaatttattgatagaaatgaccttttgttgacagatgctagtatacacgaactgcaagattatattaggtttttgtatgagaagggatataaagcaaatactgtatcgaggaaaatatcagctattaaaaatttatatgggtttttatatagagacaatatcattgagaatgatcctactgtgtatttggattctcctaaattgtcccgttctcttccgaaaacgttaagttatgaagaagtaaatatattacttgatgttgctgctttagatgtttcacctgatggaagaaggattaatgctattgttaatatattatattcttcaggtatacggatttctgagttagtgtatttgaaattccgtgaagtgagagaagctttagatgatggtgatacagaaatatgtcacatgaaaattcaagggaaagcaaaaaaagagaggataatattgttaaattcatctgctgtaacaagtatacaaaaatatatggaagtttatgaatattttattccaaatggatataagatgtcacagtggttgtttcctggtacaaagtttgataatcctgtaacaagacaaagggtaggtcaattactaaagaatttagctatgaatgctggtatcaatgttactcatgtttctcctcataaacttcgacattcttttgcgacacatttgttgaataatggatcagatattgtttttattcaaaagatgttaggacatgctaatctagcaactacacaaatatacactcatgttgcgagtgaaagattaaagagtatactactaaaatttcatcctttacgtaataaataagggtgtatgcatattttaatgatataagcaaattatttgtattgctataagagttgttggtttagttaaagttggcgaatttggaatggtatagaaagttggcgaatttggattatagtattgcatagattgaacaatatattacatgtataagcttgtgtttttggtgtagacatatagattttcgcattcaagtgcagtttgagataaatagtttaaaagccataaaagattagtgaaagttagaagtattacttctagaaatttatttgttatgtttaattgatctgtacagtgataaaggtattaatttttatatacttagaaatgtcagtcctattatattttgttgaagcctgattcatcaatgctataacttctcagtatacctgaatctattttaacgatacgacatgctttttgagctaggctgtagttatgtgttgcaaggagtatagcaatatttttttcttttgcatattcttgtagcaaagaaaatacttcaagtgcagtattgttatctagactaccagttggttcgtctgctagaactatcagaggacaattgattaagcttcttgctattgcaacgcgttgtctttctcctccagaaagctgtgatattggcattgacaatttatcttgtagtcttacgcgttctaaaatttccatagcatttttttttgcaatggacttacttttacctgtaatgatttgtggtaacatcacgttttctaatactgaaaactcctgtagtaaatgatgaaattggtaaatgaatcctagaaaatggcgacgtaaatatgttttatctttgtctgaggttttatctgtgcactctatattattgagcaatatactccctgaagatggagtgtctagtaatccagcaatgtgtaataatgtacttttgcctgatcctgatttacctattaaagcaacaatttctcctttttttatttgtaaagttgcatttactataactggtacttctttattcctaccaaaagatttgtaaatattagctagagcaaatactgtagacatctttcatccttttgcagttttaatgatattagcatgtatatgttgttaaaactatatctgtttataagaaagtcatatattgtaaaatttttttaaataatgtgagtgttgtgtaaattgtatgatgaatagcgaggtttttatgtatatctgtggaattatggatatggctagtatgtatttataaagattaataatgtatcatgatgtttgttaaaagcttgacatagcgtgttatctggcagtatacaagtgaggctttaatagaagtgtttattgagtatgttttatggtagatcttgaaaataacggttttgatgaaaagagaaaagaagctcttgaattccattgtaaggatttaaaacctggaaaagtttctctgttacccactaaacctctattaacacaaagagacttatcattagcatattctcctggtgttgcagtaccttgtttagaaatagctagaaatcctgatttagtatatgaatatactgcgcgaggaaattatgttgctgtcatttcaaatggtacagctgtgcttggattaggtaatatagggcctttagcatctaaacctgttatggaaggtaaagctgttttatttaaacggtttgctgatattgatgcagtggatatagaagttaacacttctgatgtagatgaatttgttaatactgtaaaatatttgggactaagttggggaggcataaatttagaagatataaaagctcctgagtgttttattattgaaaaaagattgagtgaaataatggatattccagtgttccatgatgatcaacatggaactgctattattgtggctgctggacttattaatgctcttgatattacaggtaaaagttttaaagatgttaaaatagttataaatggtgctggtgctgcaggtattgcatgtcttgaaatgataaagttaataggagttcctgctgagaatataactttatgtgaccaaaatggggtaatatataaaggtagacaacttggcatgaatgagtggaaagaaaagcatgcgattgaaacagaaaataggtctttgaaagatgcattgataatggctgatgtatttcttgggttatcagttaaggatgtgttgagtaaagatatgctgttgtctatgaacagagatcctgtcatttttgctctagcaaatccagatcctgaaattaatcctaatgttgcacatgagattcgacctgatgctattatagctacgggaagatcagattataataatcagattaataatgtaatgggattcccttatatatttcgtggtgcgttagatgtacgtgctaaatcagttaacaatgagatgaaaatagctgcagcaaatgcaattgctatgttagcgcgtgaatatgttagtgatgaagtgtctgatgcatatggtggtcgtaaaatgaattatgggaaggattatattatacctactccatttgatcctagattaattactgtagtatctcctgcagttgcaaaagctgctattgattctggagttgctagaaaaaatatagagaattgggatgaatatactaaacagttagcatcacgactatcattgacttctaatatccttagtatgatgtacagtgctgttaaatgtgatcctaaaagagttattttttcggaaggagaagaagaaaaagttattgaggctgctgtacagtggcgtaatcaagaatatggattacctatacttgtagggcgtatcgacaaagtgcaagaagcatttgaccgtttaggtattaaagatacaaaaggtatagagattgctaatgcagcaatttctcaacgaaataatgagtatacagactatttatataagaaattacagcgtgaaggatatttatacaggagttgtgtacgagatgtaaaaacagatcgtaatgtttttgctgcgtgtatgcttgcatgtggtgatggtgatgtgttgattactggaatgacaagggggtattatgcttctattaatgatgtacagaaagtcataggttctcaaggtgtcgtatttggattatcaataattgttatgaaggagcgtactatatttgttgcagatactgctatacatgaatctccaactccagagcaaattgctgagatagcaattcaggcatctgttcaagctaagaaaatggggtatgaacctcgtgttagctttatttcttcttcaaactttggtagtcattctcaagaagatgctaagaaaatgagacaagctataaaaattttggatagttataatgttagctttgaatatgatggagaaatgtctgttgatactgcgcttaatccagagttgttaacattataccctttctgtaagttaactggtgaagcaaatgttttagtgatgccaactcttcatagtgctagtatatcttctaagttattacagagggctgctggagtatctgtaataggtcctattttaattggaatggaaaagcctgtacaaattgtacaaatgtcttcttctgtgtctgagattcttaatcttactgtacttgcatctttagtgaataatactaatttttaatcttcttgtaaataattgcgtgtatataagattatgaatttgtattaatatatataactgtattaattatttattaagcatcgctatttattgggttatactttccctgatatttttatacatgattaatattatttatgataaacaaatagtagatgtttttttggttcgtcgatgagacttttgatatattctggtgggacaattttagtatttttattatttttaataatttctcctttttttattaattggaattcttattatgcgtctcatgtgcttaaacaaatagaggatatatcaggtgatgtatctgtaaagggtgtggggaaagttaccgggagattaatcttacctaaaattgtgatcaataatttatatatagaaggtcatggcaacgaattattaaatcataaatcaacaatattaattagccgacttgaattaaagatatcattgttatctttattactgttttctcctaaagttaatgcaattactatagatgggttaaatattccattaggtaatcttcttgatctattttcttcatttcaatctaaaaattttaatataaaaacgtttaatgtttttaatagtgttgttaatacaagttatgatggtacatcttttaatagtaagcctatatccattaaaagtggaactataaaaacagttagtgatatgaaggtaataaatggtttattaagtatcggtaaaaatgattataatgtagttgctgatatatcattaaatgaagagcatagaattaatgcaaatatttattctcaatcaacaaaggtaactttgtctggtgtagctgctggtaatgcatttgatggtgtgatattaactaatgggagtgatttttcacagtttattaatgatatttctgagaccaataaaacttctatcttttctttcattaattctcatgaagagttttctttatccactaatataaaattattagataaaacttttgaattaaatgatttcaaattgtctactgatagtatggaggggataggaaaagtaatctgttcaaattatgcatcatgtagtgctaatattgatttttcgagaattgatgtggaccgtttgtatggagttaaacatgaaagtgatgtttatagaaaagattctcgtacccttgactacttgaatacattaatatctgaaaatttaaactataacattaaagctagtgctaaagaaataaagtaccatgatcaagtctctagtaatttaataatggatttagaagtatccaagggaaaaattagcatcaatcaaatgacaattatgttacctggtaataataatgtattacatgttgaaggtaatgttggcagtaatgatttgatttctagttttcatggaaaactgaagataaatggggatgacttttgttcttttgctaagtggttatttccaatacaagttgaatcgaaatctagtgataaattttctatacaaagtgatttatacgtagctcctagagtattttctttatctcatattgaagtattaactgacagttttggagacgtaaaagggcaattaaggataaagtatgataggaaaggtagtgctgttgttggggatatagaaatacataatattgattttgatcagtacaagataaatgaaaaattgaaaatagaagactttatgccgatgaaatggttaaaggacataaagtataaaataaatgttgatactaatattagtgattttattattcaaaaacagcaggtgagtaatctaagctttttagttaatgtaatgcaaagtaagtttgccattgataaaatacgctttaatggtgctgatggatctgatcttagtggatttattaaagcttacattggatctcaggatctaaagccaaaaatattagttagtcttaagggtaataagtataatactgcattcataaaatttccttctttgatacgttatgtccttgatggatcaaataaagtcactaatataaaatggtcaaatgaagatctaaaattttatggattagagcatgtagatggtaatattgatattaatattaaaaattttatttctaaagataattcattaaaggactttgtattatcatctagtttaaaagataatttaatgtctgttaacaaacttatgtttaaggtagatgatgggtttgtatcagctagtggtaaaataggtatgggttctaatacttattcattatctgctgttctgtctatagccaatattggattgaataatttgcttaagcatataaatgttgatggaattactggaaatgtaagtattagtggtagtgttcaaacccagggtaagactttagttgattggattaatgctttagatggtaaaatggaagtagttgctaagggtgtgaatgttgttggagtagattttaataaatttattataagtttattagatgttcagagtaaatcagatgttgctgcgttaactcagattggattgtatgaaaataatacagtatttaattttattagtgctggagctaatataagaaggggtaatattatatcttccttgcaatttgcaattgacaatgctagtggcatggcatctgcaaatatttctttattacagtttgctgtgatgtctaaaattaggttatcatttatacgtcctaatgtgtcttctccatctaatgtagatatgtcattaaatggtcaattatggcaacctaggataaattttaatgtaaatgctctgtatgaagagattgtgaagggaggtagtcaatctgtttcggcacatgatgaagagtttatagattaaagttgcataattatataggaaataatagttcatacattgaagcatgcctttttgttaatgttagaaatactaaggttttgttttgacagattatttgtggcttattggaaccttggtagattgatatatatatttattatagttggggcagaagttaacttaggatgtgaatttagataatataaatcttaataagactaatattaacattatcggtatagcgaattgaatggtaatgaatttgttcaaatgtttagaatatatagtaccttcacttatatggtagggtaagtatgaatcaatgataccttctgtcattataggtaaagagttgataattcttccgtaactatctattactgcagaaataccattatttgctgctcttatagtaggaagcccgttttcaatacttcttacacggttaatttctaagtgttgataaggttgagaacttataccgaaccagccatcatttgtaatattaataatccattgtccttttgtacacctacttgtaacttcgttactgaaaatagattcataacatattaatggtataaaagggctttgattatttagtgatatagacttttctttgtttgttccaggactataattaagcctatttgcaatacttttagggattagattttttaatatagatggtataaattctccaaatggtactagatgtagtttatcatagaaatctattatttgaccattatcattaataacaaataatgtgttgtgaaacttattgttttcaaatcttgtacctccagcaattaaaaatcctggtataataaatttaagataattttgtactgatctactgtttgtgtctgttaaaaaggggaaagaattttctccccaaactacatgtgttcttgaatttaatccatatttactggttaagcgtagatatgtttgaaatctatcatactcctgctcttcatttccgtcccaatgactttcagtatttccttgtactatacgtatagctatcttctgattatatttctgttcttggttatttgataggcgatcatttccataaatgaacatgcttactaatattaatagtgcagtgatacatggaagggtactcttgtctcttatagacactccagcagctgtactacagaatatggcaagaaactccatgccatatgttccaattaatgaagcagtttgcaacatttctatggagaaagaccaagaatatgcaaatagattccaaggtactatatatcctaacaacatgctggcaatagtgaaagacagtgagaaagttattaaaccgaataatttcttgtaattaagcgtataactaatagctgcagctgcagcaaataataatgataaagatgctgaaaggatgagggtaagaggtattagtggccaaaaaattttgctttggataattagtggaacattaacccagtatgagctggctgtaaaatatccaaaaccaaaccaccatccacagaagaaagcttgtcttgtatttttgacttgtgataatacaatgtaaaatccagaaaatgctattagtaaagcaataaacatatggaaaggtgccatagatatagcgcctgcaactcctaatatcattgctaaagtatagttatattttctgtaaaaatctccttctatcaactcgcttgccctacattaacattcaactgtaccaagtaaagactagtacgctgactattgtaaatattttttatgttatgtaaagcataagactttataatttattttcaggatccttatgattttttataaattgaaaagcttagtatttgagtcttgaatgttggtgagataattaaatgggtctgtgaattcattatgaacaagtttttattattaaggtttggtgttaaggcctatagtgcgaagttggagtagactatattgttcgctagtgccattggagtatatgtaagaattatacaatttaatataaatatggtttatatatttaaagtagcaaagtatttctttaatattcttatttatataggacatattgtaatgttagtttttttgtatctgttgttttgaatgataaactaacatattaaaggtagagaccaataatttattacattttttatgtaaatcaattaattattgctattttacaataaaggcgcttgcctttttggtaatattttagtaggtttgtcaatcatatattattgaatttatgggtatatgtgatgattagttcgttacctgttttacaggttgttatacctttactttctgcgataggatgtgcattgttaaaagatgctagattagtcaagattatatcagctattgtagtgttaatatcttccgctattgcagtagtgctattttttcaagtatatcatggtggtgttattaaatatagcataggagggtggatagtaccttatggaatagaacttaaggtaaatgtctttaattcgatgatgcttgttttagttgggtttgttgctatgatgagtattgtatatggtatctaccctaataccaaagaaataaatgtacgtacaataccaagtttttattctgtatttttgttatgttttagtggctttttaggaatattagtttcaaatgatgtttttaatatttatgtttttctagaaatatcatcaatttcttcatatatcttagttgcaatgggtaataacaggaatgcattgatagctgcatttgattacttagtaataggtaccattggtgcaacgttttatttaataggagtagggtttttatatgctattactggaactttaaatgttggaaatttgtttttaatagttcaagataaatctttaacgacaaatagggctatacaagttgggttgttgttcataatgttaggtttgtttattaaagcagcactatttccatttcataaatggttaattcaagcatataattatgcacctacttttatttcggtattcttctctggtgtttctactaaagtaatgatctaccttataataaaagtaatatatgatgtttttaaagctgaattagtactgttaactttaccttttaatattgtatttatgagttttgctgcattatcagtgatttctgcatctattcttgcaatgctgagtagtaatatgaagagaatttttgcatactcaagtgtagcacatctaggatatattatatttgctgtaggtttgaatacttactatggtttagtggctgctgtaacttatataattaaccatagtttagtgaaatcagcattatttatggtcatgggtagtatttcttacaattgtggtagtcttgagcttaaagattgtacaaatatttggaaaaatatgccaaagattgcgttaccatttgttattttatgtataagccttattggaatgccaataacttcaggatttatttctaagtggtatgtttttgatgcggcaattaaaacgaatttttggttgggtgtaattgttttacttataggatcaggtctatctgtggtgtatgtgtggaatataatagaagcaacatgttttaagccatctgataaacaagtgaagaaattgtttgaagttcctaatgttatggtgttatgtatttgggtaatggctatttcatctattattcttgggttatatccagtacctttaatgatgatttctaataaaatagcggaatcactgttatattaaattagtgggtaaagtttttggtgcatttgtaatttttggaagggataccttgatatatttttcgtgaattgacttttatatcttcaaggtatttaataaaaatcctgttacttaaattcctgcaaaccattgaacaaccacaatttttacttttgttttcttctcaaataaagcagcagctttattaaaattaaagtaaatttgtttagatattatacaattattcatttttaaaagattgtactaaacaataatttaatattttagtgaaaaattaattatctgcttcttccttgcattttgctttcgaatacttgagatactgattcaacaacaaaaaagttgcttccttgactgtgttgagtactgtgctctggtatgtaatttttattatgtggcttaggtgtaaaggtactactactactattgttgttcgtgtatgatgtcgttgattttttgtatttagatttactttttttacgtttaaataagtaagctatacctgctaacaacactaatacaagtaaagcagtatactttggattattaataatataagataaaatataatcaaaataactcataaccatattactttgttaatacacacttctttaataataacattaagcaattgttttgaatagtaatttaatgagaaaaataataaataattcttgtcttgtattagaaatatgtacaatatgtgatttcagttaaaaataaatttttattagttgaaatagtgttattcaacaaatttgtttgctaattttgtaagaattacattcaataagcaattgttttaaatagtaatccaatagagaatataataaataatttttatattgtaaaaaacatatacaatataagattttagttaaaaataaatttttattagttgaaatagtgttatttaacaaatttgttcactagttttgtaagtattacattcaaatttaagtctgaacttgtgtgttcaataaatccttccacaggaataacatcttcatttgatcctagggcaatatcaatatgtcttctccctagtaggttagagagagataatgatgctgaactatctgagggtaatagaatattcttttgtatacacattgtaactgtaggactataatttttgtcgagtgatattgacgttactgtgcctattttgactccggataatgttatatcgtctcctatatctaatccgtctacacttggaaaatgtgctttgactatatagcaattatgtgaagtagtgttaagaggtagtttcttaaatgctataattccaatagatactgcagctactagaacaataagtcctgcgaaaatttcaattacattagatcgacgcataaaactaccaatgatgtttgacgttattttgtattataaaaactaaaagttttatttggatggtaagcatattgagttccagttaagtttggaaggtgtaaactttgtgaagattttggcacctgattatctgcataatgtagccatatatgccacggtgcaggaacttttgttggatctgctttaccattatatattacccaccttttttcaattccatttgctgttgtaatatagtaacgattacctaaaatatccttaccaactaatttcttattcctttttactaggaattgtagattgagaaagagtttcatattttaataattggtaatttattttacatcagtataatagttatggtaatacaatacaactattaactagatatttagttaatattttatgtaataattagcttaaagtgataatatgtaagtaattatgaaatgtcctttttgtaatagtactgatactcaagttaaagattcaaggtctatagaaaatgacatgttgattagaagaagaagagtatgtcttgtatgtcactctaggtttacaacaactgaaaaattacttcttagatcgtttatggttgtaaaaaaaaatggtgaaactgaactatttaataaacaaaagttactttcttcgattttgatagcgacaaaaaaacgtcctgtaagtcatgaagggataaatatgatggtgaataatattttttatgagcttgaaggaaaaaaagaaaatgctattccgactaatgttattggaaaaatggttatggataatctttttaagttagataaagtagcatatgttagatttgcttctgtatatatgaattttagaaatataaatgactttagtaatataattgcgaaaataattagtgaaaagactccttaatgcatctcaataattatattatgattgattattattcttgaattgttaataagcttgtgctatgtattttggaggttatttagtagtaacgttatctcgctgtggttctatgggggtatagctcacttggtagagcgtctgctttgcacgcagaaggcaagcggttcgattccgcttacctccactttcctgttttaaaagataagatcgcatttttagtaagtttattattttcaataaaataaataactactataaatcctaatgttacctattttatgcactacagaaatattctattgtactaacccgaaatcataattgtcgataaatatgtggttattttgattaatatagacattatcattttcttgttcttttccatagtctttaaagatattgttgtatgcactccatacttgatcataactgtaattttcttttatagcttcatagaagtttagccatccttcatatgtcaaatcaaaagatatgtgatgtttatcctgatctatgttatcacctatattaatgtgttcttttgatagtggaaaatatatagtatcaatatcttgctctgtaataggatcaaaggtattaccttcattggtatgatgttctttatctatcaacttttctggtcttgtgttatcttctttttgatctaaaacgttgtgttcttgtattgtttcacttgcttgatgtgttatgtctcttgcagagatgttgtgtgtttcattctgagaataatctagtggtaaaatagttgataagtactctgttagtcctgtatttggaagatcaagaatatgatttccttgtttgtcggaaaaatatgtttgggtgtgatctccttcatcagatttaatagtaatataaatattggttgagtctagtttctcttgtgagattgctgcaaaagatttagtaaatccagaaatgggttcatcgtacttaaagacttctctaacattattgcaatattcaaaggaaaagtttccatcaaagaaaagatgtgtattatcatcattaggaattaatgctatttctttatcttctagtattacgctggcaaaatttttgccatattctgtttgtaaatcgctcttcacaactttgaaaataaatttctcatgcatatttacgtagcgattgtcattcggtatgtcttgtatttgaaaattagcaaaatttaacactcttaatgctgtattataatcttttactaatgatccctcttgttctatatctgtaaagaagaattttccgtcttgtattacaagaaaaattggagaattttccatttcctcttggattacatcatctctgatattgtgtaagtgaatgcttttatcatcattgatgtggtgtttactaatatcagaatagttaaatatgaaagtatcatgatttgcagaagagtaatgtttgtattgtagagattctggacttaattttgcaaacttttcattagaatgtaagtctaaaagtatagcaggagatgtttctgtgtttttgtatggttcttctgaggatattttaaatagtgggctgtctcctctggtcttttgtacattgtaatattcttctaagtttattgtttccggtttttcaattatgttttctggtctaatatagaatttttgataattataatggtatgcttctccattttgatcacatatgactaagttgtaaaaatcttgagtttctttactgtatgtagtgtattgtgtacgttctacttttatgtattggtattcagaaggtatgttaagatagctgtcatgtaggtaattgttgtatggaacataaaatttatcacctacaaagaagtaattttttgatggcataactatttcagtattatcttcagttgttattttaacagtgtatatattcctgttacaaaaaccgtgtaaattttctcctacttttaatttaaaagaagatgcttggtttgttgtgattggtatgttgttgttcatattccctctcttaataattattaaatattttatataattattacttaattataatttttatgttgtaaaaaacattaattaataaattcattaatatttttagataaaaatgtcaatatattatatctaaaaagcaatcaataagttaatttattaacttttttatattgacattttaacatatcttgtgtatgataccgatctaaattaatatttattaacaaatgaattatatgacagtttttttcgaatataatggcagtaaagttaacactaaggaagtagtgaaacgcaatactgcaggtagaacagatcaagataaggactcttctacctatgtatataatacttataacgctggtgatctacaagggcatgtacaacagtcctttatgagaaataatgctgagcacaatagaacagatactgttcttccttataatgatagttatgagactctacctgttgtgcctgctgtagaaactggtgctgatggtaattcaggtaagggtaattctgtagattttaaatctaatgttttttgtaatacgcatactataagagacgatcagttgaaattaaatctagaaatacacactttaggaaatttatctgatagaagattacaggagattaagaaaggatttgatgattcaataataagatttaaagataattttgggttggaacccaatgaaaaagatactacttttgaattatatctttttgatgataaagaacaatatgagcattatggacggctttataatctaggaataaatggagctggtggtatgactttttatggagatgctgatgttccttataaaatttatgtatatcagtttggtgaaatattaaatttaaaacatgagttaactcatgctttagagaattatgcgtctggacactcattgtctaagcttaaaataaatcatgatatatttacagaagggttggctgactatatacaaaatgatggtacttttattatgagagaattaagagataaagaagtaacatcaagtgtattgaaggagggttcttctaaagatatagatcaagtcagtgatgctgcagtagctaaggatcagcatttgagttatagtataggacacgcatttgtaacatttttacaggagaattatcctggtgtgatttcagagtactttgcagcattgagggaaggtaatgctgtgcatgctagagaaataattagcatgaataagtatgcagattttgaaccgtgggtacagtctaaagacatttctttgtatctagaaggcatgaatgtattaaagatagatttaggagaaaaaatgttttctgctaaaaacgctgtttcttttgaaaataagaatgtaagaaatgaatattactgtgaaaacatttgtactatgaacggtgaagtagtagggaaaatatctcctgtggtgcattatgccgataaggatactattcgtacttggaatattgcgagtactgatatgatagaagtaaaaccagagtatagttttctaaaattggttagtactccatctggtaagtctgcatatgtatattgtgataaggatggtaatgagtattttaatactcaatcttatgtggaatatgcgtttaatatcttgaaaaaatatgatgagaatcttcgtatcaatggtgattttttagatattagaggtcgttactcagatgctgataaagtgtttgataaaattcctaacgcagatttgttgttggatcagttcttagataaaattggttatggaaattataagcaagtaataatgagcgacccagagcaggttagtgttataaaaatgcatatagtaaaaaaagcttttgaagattttagagaatctgaagtcaaaaaagtgtttactggtgaatcaggtgttgattctacaataaaaaatctattgatggatttaacttatattaatttaagtgatgtgataggagtaaatggttctaatattgaaagcattgtatctgatccaaatgtaatgttgcgtactgctatattaggtaagggagatgcaagtggaatatctctgtatgtaggtgatcaaaaagtcgctgaattatctactgaaggaggttattgtgtgaaggatcttgatactaataatgtgaattttgtattccgcaatgctgttggaaacatagcaagtagttatcaagatagagcatacatggttgtatgtgaaaaagatggtgaatttactactgctctaattgatgatatacaaaagacagagcatggaaatgttatatgggataatcagtttaatcatcctggtgttaatcatttatatccaaattatcaaaaggtattattaaatgatgcttcacttaaggattattcccatcttgctaatacaaggtttcatcatgatgatacagtaattgtacggggagatctgttggatgacaaaggaactgttacaacgagtgatgacattcatcaagcagtgattaaacatgatgatcaagtactacatcaatttaaaagtatttctttttacataagtgagccatcaacagatagtgctggaacttatggtagtgatttctttattgctgatgaagggaaaaatcttagatttcaacttcctaaaacaattactcatttaaagttagtaaatgttgatgggaatcaaaaattagtaccatgtactgcagatggtaatgagcaccctgatggtatgccatctaatttaacagatgagtatcgatatattgatcctatttttgctcacacatttgagaaacaaagctattctaaaaatagtgttagcattggtttggtagattttgataaatatcaagaaggaactatgtttaaattacagtattattctgatgattatcatattaataaggatgaacatggtaatataattagacctaataatgtgtcttataaaacaaaagttgacctggtatatgatgataaagttattggaatgttatctgataatgtaaataaatttcagggagatgtttttgttgctgcaagccttaattatagccacagtgattttctttcgtctaaatattttcagaaggtcaatattgaagcgttagaaaatggggtatatagtggaagatatgatgtaggaagtggtgatgaaatagccaatcttgatactgatgtaggttatagtgacaaaactgttttttattttaaaggaagtaattcacctgttgatgtattagataatgttgatactgtgtctactatttcaccttatattaatgagtttcaatagattttaaaaaagaagcagcgttcaatgaatgctgctttcttgtatgtgtagagtcatttttccgtgtgtatatttcactataaatgaattttatatgacgttgtgaataattctacgattttacattgcatgtatagttttggtagattaaaaaagtagtgttttatatagattatgaaaacgttttttaatgtatatttggttattttcatagtgttttatatgaatatttttatacgtttttaatttatgaaaagtatatttataattataagtgtgctttaaagtagttctataattatatcaatattgcatttattctgttgtcttgtataatagtagggttttgaatatttatggattaaaacgatatgatgagattaattgcttgtcttggtattatagctgttgttatcctagcctttagtttttttactaaaaagcagcaggttcaagatttaacacaagaagtacgagtatattcatctcgcaaggaagaattattacatagtttgtttaaacaatttactaaagaaactggtataaatgttaaatacatcaatgacgaagccgctcaacttattaatagaatggaaaatgagggtactgctacttcagctgatgtatttttaactgcagatgctgttaatcttattcttgctaaaaagaaaggattgttgcaacctgttcaatctgaagtgttgaatcaagcaattcctagtaagtatagagatagtgaggggttttggtttgggttaactaagcgtgcaagggtgatagtatataacaaagatttagttgaaaagagtgacttaagtacatatgagcaccttgcaaatacaaaatggaaagataaaattttagtaagatcttctagcagtccatataaccagtctttaattgcttttatgatagcaaataatggtatagaaaatactaagatttgggttaaaggtttagtttcaaatatggctaggaagcctagtggtggggatatagatcaaatttatgctgttgcagcagatgaaggtagtatagctatagttaatagttattattttggtaggattgcagcttctgataagaagagtgatcagattgcagttaaaaaacttggtatctttttccctaatcaggaaaccacaggtactatgattaacattagtggtggtgctgtaacaaagaatgcaaagaataagcagaatgctataagattgttagagtttttaactagcgtgaaagcacaaaaggtctatgctcaagttaatcaagaatatcctgttgtagaaggggtagagctctcagagattttagggacttttggttcatttaaggagagcaatttgcctttacaagaattagagaaacatttgactgaagctgttaaaatggcagatgagtgtgggtggagatagtttttgaataaattgaattctgtatataagtttacttcttagtctagtgtttattagagttaatttattatcaaaaagttctttacgtcatacagagcttttattaaaaggttatattttagtttcttgtacattaacttgattagggtaggtttttacatactgtatgtttcttaatgattattgggtattattaaaacatgtatttctgtatgctcgctatgggggctgaaatcttttatgatactgtatttgtgacctgtttggttattaagataatgagctttttgttgcataacctatatttgctgctaatctcggtcaaaatattattacttcctatatttattatggattccttagtttcttaatatcaaattttagttattttattgtaagagctgtggtttttatttatttagttggggctatagcatttttatttattggtaggaagagaaaattatttaatttatcgtccatttattagtcttatgcagtaaaccgtaatacttatatgcttacttgcactttagaattatttgcttaatctttgtacaaccattttgattggtgttatccaaatttacctatatggctttgtaataatagcttgctgcttgtcttatttacctattaattatttagggctgtaatacgtcacaaaataccaaaaaataacacctattagcaagacaaacagatatttgtttagtctgcttaatctttgtacgaccattttgattggtgttatctaaatttacctatatgctttgtaataacagcttactgttttttatttacctattaattatttagggctgtaatacgtcacaaaataccaaaaaataacacctattaagcaaggcaaacagatatttacttagtctgcttaatctttgtacaaccttttgattagtgttatccaaatttacctatatgctttgtaataatagcttactgcttgtcttatttacctgttaattatctagggctgtaatacgtcacaaaataccaaaaaataacacctattaagcaaggcaaatagatatttgctgtctgcttaatctttgtaaccttttgattagtgttatctaaatttactgtatgctttgtaataacagcttactgttttttatttacctgttaattattatataaggctataatacgtccaaaatactaaaaaataacacctattagaaagagaagcaaaaaggaagaaagacctgcactataaacattactcttattaaaaagcacattatatgtagtaaaaaccgtagcgttaaaagtacactaagctgtttctatattaataatacctttctttataaaccaggatattctgtcagttgcttgtgcaccaacacttaaccaatactttaatctatcaaccttgactttaacaaacagttcatgctctttagggagcattggattgtaaaaacctaaagattcaatgaacttcccatctcttgcaaccctagaatcagcaacaactactctataaaaaggacgcttttttgctccaaaccttgctaaccttatctttacagacatgagaatataacctttaaaatatgttgaatactttcaaatcatacacataatagtatggtgagtcaaattgaaaaatgcatttttaaatatttaaaatcttatctttaagttctttgaggaaaataagaaatttgcaatatgttgttaaaagcaatatgattaattagtcaagcttgttcaaattatgaaaaagtgaaaagatgtcctttttgaaaaggatatgtaataggaggatatttaagttatatgaatttaagaagagctgtgttatcgacaatcatgtgtaatactttagtatggtatgattatgtgttatttgggaatttggtgagtgtaatcagtaaattattttttccagcagaagatagatattttagtcttattatgacattcagtatttttgcagttggatttttaatgcgtccttttggggcaagtatttttggttacattggcgataaatatggaagaaaagctgcactgactttatcgattatagcaatatctgtccctattacttttatctcaatattgcctacctatgaaaaaataggaatattgtctcctatattacttattatttgtaggttgatgcaggggatatctctaggtggagaagctggtaatgctactttcttaatagagcattctaaaaagggaaaaaacattggtttttttggtagttttgagacccttagtgctgtgcttggttctattattgcattatttatgatcttgttatctcagtactttacaggagaaaattttgaagtatggggttggagaataccttttgtaattggtttattattgggattaattagtgtttatattaggcgtattactggtgaaagtcctgcgtatgatactcataaagaaaataataatctttctcaatctcctttcttagaattgttaaaaaagtataagcgccctttagtcttggcaacatgtattgactgtgtagaaaattgttcatttcatatttttatggtgttttttattacatttattaaggagttctcaaatattcacctgaatttaaatgctaatactataagcattattgaaagttttaatataatgatttgtggtattttgaatgtattttttggatatatttcagattatgtagggcgtagaaaagtaatgttaattgcatctgtgtcattgttttgtgttgcaataccagtattttggttattaagtcaagatagctatgtttctttgattgctgcatatttaatatttgtaattccgttttctgcaactttaggtccagcaagtggtgcaatgtctgaattgttccctacaaaagttagatatactggttttggattatcgcgtaacattgcttcagctatatctggtggtatggctcctgtagtatgtacatggcttataagggcaacagggctttcgtttattcctggagtatatgttatgttttgggcattggttggagttattgcattgtgtcagatcagaaaaaaagatgtttatgctgattggtaatctactatttaaatgttgtgcattgatctaatgtagtagctaaaatgatattctcactagaatgaatagggtttttgcgtggatattttgttatatctggttttaaggtggttgtttagtgatattgcattaagtgtgaaatgtgtacagctattataaattttgattggtgttatctaaatttactatatgctttatggatggcaacctactgcttgtcttatctagctattaattattataggggccataatacgtcacaaaatactaaaaaataacgcctattaagaaagacgaacagaaaggaaggagaaaacctgcgctataaacattaagtgtatatacaactttattaatttgatgttatacagctctgtaatcagtagaggaatcactcttctagttttctggcttcatcgatcagcataattggaatgccatcacgtattggaaatgctaatttggctttttcactaattaactcgttagtgtctttattatattgtaacttgtcttttgttaatggacaaacgagtatttcaagtattctatggtcaaacatatttgacaataaagtaaagttagttgattagattataacatttattatgaaaacatgaactgtagatttttttaatgtagtaaattgttaaaaatatgggtctgtagttggtgtgtttttaagttttataagaagcttaataaacttataaaagacacatgatgtattattaaataacctaatactataggcctttatttggatgttattgtaatatgttacatttaaagtgcaaaaagctatttataccataacaagggtttctaattattgtataaaatttacagtgccagtttcattgttgttatcatctaatagttctgctattctggtaaggatagtcttaacttctatgttatccattatattatgatggtttatgttatctagaaagtggtgaggaatcattttggggccaatagcattgacttttatttttggtgataattctacagctgtaaattttgttaaatctagtagtgatttttttgacattgtgtatataaaatattttgtactatctttcgtaatcattgcatcaatcatattaataacatttcctgtagtggtacatttttttgcgaaatattgcgttaaaaatagaggagcacgtatgtgcaaattatagtgatcagtaaaatctttaatagaggtattcatcagtgtgtttttgtagaacactgaagcactgttaataatgcaattacaatagggcatgaattcaaaagtcttatctattataggacttagtgaatcaaattctattaaatcagcttgtatgagaatgcacttttggtggtataattcttcaatagtattttttgtttgtaacgcatgtgcttcagaaatgttataatgaatggctatatcatatccattgttagctaagaacattgctattgctttgcctaacctacgtgcaccgcctgtaattaatgctccttttttatgtgttttcaacatgatacgagatgggtaaaacaaaaaccataatgatttaaccattgtaatttgttactatagaatttacgcaggtcgctaatattatatttgagcatggcaactctttcaataccaatgccaaatgcaaatccactatattgatctggatcaatatttacatttgttaaaacgttacggtggaccattccacatcctaaaatttctatccaatctttttccccacactttatatcaacttctgctgatggttcagtaaatggaaaatagctattacgaaatcttatttggatattttctccaaaaaatttttttaaaaagtaatgtatacaatattttaggtgtcccatattaacatttttatcaatatataaaccttcaatttgatgaaacattggactatgggttgcatcccagtcattcctataaaccttcccgggggcaataattttaattggataatttcctttgttagcttgcattactctgatttgtacagaagatgtatgagttcgtagcacaactcttttttgatttactaatgtttttaaataaaaagtgtcattttcttctcttgctggatggtttttatgtgtattaagtgcatcaaaaacgtgaaattcatcctcaagttctggtccatcagataatttaaaccctaaagatgaaaaaatatgtcttacttcatgtaaagttttagaaatcggatgtaatttagctatttgtttcgggcgaactggcaaactaatatcaaccctatcttgcatcaattgagcattgatttgtattttatgtaatttttctttttgagaattaattaaagattttagttcagcacatatagcatttacactacttccaacagatttcctctcttctatattactaattgttgcaatactttttaaacatgctgttatagtgcctgacttaccaaagtagtaaagctttatgctttctaactcttcaagggaagagctagatagtatcttgttagtagcttctgcttgtaagttgtatatattactgtgcaacacgagatttatttaaagcttctttaataagatctacaatttgcttgaagtgatccttatggttaaccgccatgtctgctagaactttcctattcaatgttacatttgctaaggataaaccgtgaatgaagtctgaatacagaagaccatgttgccttacagctgcattaatacgcataatccacaggcttctgaaaaacctcttacgattacgtctatcacgataagcgtattgtaatgctttttctactctttgcaaagctatcctatagcagttcttggaacgtcccctataaccttttgctagcttaataaccttcttatgccgtgctcttgtcgtaacaccacgcttaactctagccattcttaacctctatctattaatactcctacctgctataaggcataaaaagtttaactatacgtgaatcagaagaattcataatagcagtaccacgttgaacgcgaatactccttttacttcttttagtcataccatgtctttttgcagattgagtagactttattttacctgttgctgtaacactaaatctctttttaacagaagacttagtttttaactttggcatctctatcctaaaatttttgcagaaagttacatcttaatctattcgctttcagagtgtcaagtacattttctaaattttactctaaataatttatacactgtatgttaatagtttttataatatggtgtactaaaatttagatgaaaaatatttctcgattaaaataacctgctacattattattcttcacgatttattaagtttgttgaaagtattacataagttattgcaaaatttatggcaataatttataagtgatacacatgcattagtagtaatgtattattaatatttatattttatttatttttgtgaatacatggttatttagttatattgagaatttggagaaatctgtatgtcaaatagtaatgttcctttagctcataaccctaaggaatcttcttccacgttagaagactctggtcctttaatgcctagggctgttgcggtatggttagtagataatactatattgacttttgagcaaatagcaaaattttgtaacttgcacctgttagaagttaaaggtattgcggatggtgaagttgctaaaggtgtggttggatgtaatccaattacaatgggacaggttacaaaggaagaaattgaatattgtcagaatgatcctactagagtacctagattaattagctatagaaattttaaaaaaagtaaaaaaaggactgttaggtatacacctgtagcacgtcgtagagataagcctgatgctgtggcatggattttaaaatattgtcctgaaatgcaagatgtatgtatagctaagttgataggtactacgaaatcaactattgctgctattagaaataaagaacattggaattcgagtaacattaaacctagagatcctgtgttacttggtttgtgtactcaagtggatctagatgaagcgattatgaaagctcagatagttgcagaaagagaaagaagagtgaaaaacatcaaggctaatgatttttctgtgtctgattcagtgtaaaattgttgtgttaataaatctttacttaacgagagtaactgctataatttaacatggtatatcttcctttaagtgttactgttatactatctagatagtacaaatcattacgtttactaaaataccaaagtgttgttgttttataatcagtgatgtttattaggctgttttgccttatgttttaattgaagtatatttttgttagctttatgtgttgttaagttagtgttaattggtgaataaaattatcatagagtttcagaaattaatgttgcatttgttaaatgcttaagtattaattttttaatattgcgactaagcatatttgtgattttttgtattgatttaaattataggtgtatagtgttaaatgggaaaaagaagagagtaaggtatgttagcaaaaaaaatgctaataagagtgcaggaatgcagcccgtgacaggtgttgtacagaaagaagaagagaaagaagtagtagaggtacaagaggaaataatagaagagaaagaagaagagaaagtaccagaacaacaagaagtaaaagtgttagatctgagtgagctaaaaaagaagacaatagaagatttgttgaaaatagcagaagaccttggagtggttagtaatggtagaatgctgaaacaagaaataatatttcacttaatgaaaaaagtagtaagtgatggaggtgcagcaataggaggaggggtagtagagatattatctgatggttttggattcttaaggtctcctgaagcaaattatgctgcaagtggtgatgatgtatatatttctgcaggacaaataaaaaagtttaatttaagaacaggtgatatagtaagtggtgaaataagagcgccaagtgagaaagaaaggtattttacgttagtaaaagcacatagtataaactttacagatatggcaaagttacaaagatatgtacactttgatgatttaatacctttgtatccagaagaaagaatattattagaatgtaatgatcctatcagcgtgagtaaaaaagatataagcatgagagtaatagatatagttgctccattaggtaaaggacaaagagcgctgatagttgctccaccaagagcaggaaaaacaataatattacaacaaatagcacattcaatatctgtaaatcatccagatatagaattgatagttttacttataggtgaaagaccagaagaagtgacagatatgtgtagatctgtgaaaggagaggtagtaagttctacatttgatgaacctggatatagacatgtacaacttgcagaaattgtaatagaaaaagcaaaaagaatggtagaacataaaaagaatgtagtgatattacttgattcaattacaagattagcaagagcatataattcagtaataccgtcatcaggaaaagtattaactggtggagtagattctaatgctttacaaagaccaaaaagattttttggagcggcaagaaatatagagaatggaggatcattgacaataatagcaacggcactgattgaaacagggtcaaaaatggatgaagtgatatttgaagaatttaaaggtacaggaaattgtgaaataatattagatagaaaaatatctgataaaagagtatatccagcaatagatatttcaaaatctggtacaaggaaagaagatatgttgatagatagtgtgtgtttgaagaaagtatggttattaagaaggctattgtcatcgatgggatctgttgaagcaatggaatttttaagggataaattgttgataaccaaagacaataatgaattctttgatatgatgaatagttaatatgggtatagaaaataagaactttataatgaatgtataagcgaaatacttataactgtagaactatatgtagctatttaataaaaagaatgaatgttgtataattagtggtattttaagagaaatccctttgattctatatttgtgacttgtgtttttgtagattgcttaattgtgaaacctatgatgtatagtcactgcttaattattacaagaaaatagttcagagttaattgtgtttatgacaaaagagataccaaactgtacttatgtttttgatatgggatacattgctgttcaaatgaggtaattgggaacttgtgatgtagtctgtatatttttatgaaaggaataaatttacagtatatgatgagttatttgatgctaaggatttacattaaaatcatcgtgatttaattgtggattgcagtggtacaatgttaggaaataggaaaaaagttgttaggagttgtagtactggtgatgctaaatgaaaaatgtgttaagaccttgtatcctgttttgttaatttaataacgtgtcacgtgcttcatttaatttttgtgctagataaggagatcctcccttgtctggatgcatggatttcatgagcttatgataagctgtgttaatctgttcttggcttgcatttttatctagtcctaatatttctaatgcttctcctctagataagctactacttgtgttttgtggactattatatacatttgcgtcatttataactttatttaaagtagaggtcattatttcactaatacttattatgctatttctttttaatagtagaagtataagcaatgcaacaattggcaatacaaatataacgcctattatagagaatattactagaaagataaaccacatataaatgacttgatttaagtaaggtatctacatattatacaagttaaaagtatttttttgcaaatggtttattatgtttatacaaattggggagactccaaatcctaatactttaaaatttatgccaggtatgcctattaataatggtaaggttagtgaatttgctgatagtgtggcagctgaaggttcttctcttgcaacagcattattcaaaattgaatatgtaaaaagtgtattttttggaggtgatttcgtttcagtaacaaaatctgatgatattgagtgggatgttttgaaaccagaaattttgacagtaattatggaatttctaacacttaattcggataatgctactgaaagttttgatcaggaagaactggaagagttttttgatgaaaaagatattgaaatggttggtaaaattaaagagttaatagataattatgtaaaacctgctgttatccaagatggtggagatataaagtttaaaggatacagtaatggtattgtttttgtaaaattgagaggagcatgttcagggtgtccaagtgcctcaattactctgaaagaaggtatatataatatgttgagctattatattccggatatacaaggtgtagagagtattcagtagaaatagaatatattagttttgctgttgtgttggaaagtactttttaagtttttaagtctataagattatctgtataagcgtttaattctactagcggtaactttgcaggggatgggttcatttattatatactaaaaaatgtttatttgatgtttttatgtagataaagcttatgtagtgagtctattgtatttacataatctacatggttagtttgttttattatataagtgttgcaatttgttatagttaaagttcatgtatgaagggctttaattctatttgtaataacctgttggtaatggttgtttttgatatcctgaaagcactgatgaaagttctatgtttggtatataagatgtgttgtagtatggagttctaatagaaacgatattaaattttgctatatttatttcaaatttaccattaatgaagaaatattttttataagatatgtttttaatagtacatctatagtatttgttaagagtattgagatatgacttttgaatatacaatgaatgatagaattatgaaagatctgcattttttagaataagtctggtatacacttaagtcctaacattgtttaatactgtattttatactagagactagtggaggtgctaggctgagtatgtgtagattttatggaagatgttgaatcaagaaacgtaaagtttgttgaaggagtgataagtttttcatatgattttgtttttttgtgacgtattacctttcttagtttgtttttaattgattttgtagagtttttagcaatgtgcaatatggctttttttgtgttttttataatgttgcttttgcgtgatttattgtgtcctgttgttatgggttctcttattgtatatgaagtacttggtaaatgttgttttgttgtgtttctggtaggatatataacatgttcatgttttatataaaacttcatattgctgacaaactctttaatagtcattgtatcttgtgcagatggttccatattacttagggatcttattgttatcttaatgtctttatagtaaggattccacgatatattagtattgtgacgtattatttgtaattgtttgaagaaaagtgtagtatcaccataggctatactttctgtaaatgcgttttctatttgttttataatctctgttttttttgtaatccttggtttaacaatataaatatggataatttgcttaagtttgttaattattgaataccatggatatggatgtcttaaaagtttttctgttttgttctgatgatcttttaattttattcttgtattgataagcttgttctgtattgaaaaaacaatatgttgtttaggaaaaaggttaagtgctgtttttggatttatcggtggtattttcattatatgttgatataagtatctgatttgttgagatattggtatattaggataattgttactatacggtccagtgattccatgacatgctattagtaaagttgcatctggattgttcatagctgatgttatttcgcttgttatttcctttattatttcccttgtgtacattgttaaacttgacatatcaagtgcatatgatcggaaaaattcctttagttctggatttatatctgatttgagaattatttttctaaatgttttaaaaagtgtatctttagtttgttgggtgatgcttatatttttgaaattactaaataatttatttaatgctttgtctataattttttgatcttcagggaatattattactctatctgagattttattgattagttccttgaaccatagttttagtaagagtctagctttttttttgtcttgtatagttttatgtgatgtattagtgtaaaattgtatgatgctatggtagcggtaattctcattatcagctgtaggaacatcacagacttctggtactattactaataatagttttaaaggatcagttgatagtatttcgaatatttcatttcttaatcgtgaatgtgtactgtattttctgactttatgtttacttttaggcattgtttaatagtaataaatatattaagtatccaatatcatgaattaatttatttgttaagttatatttataatagtataaataagttaatttattattctaaggaaaaaatttattgatgttgttaagtcttgatattctttgaaatgttgaataagtgataatttagaaatactatcatgagtttttgaaataatatttattaatgtaattttgatgatatatattgtaatactttttagatttttaaaattcaagtatgagtgatgtattaattactgttgttgtgaatcagaaaaaaatgttgtttaaaccaggactaacacttagtgaagttttaaatgagtgtaattatgatactgatttaccatttgctgttgcagtgaataggagtttagtagtaagaaataaatatgacagtacttacttaaatgatgaagatattgtagatatagtgtatcccatgcaaggtggataaagattagtgtccttatttaatattatgaagtgtcgattatactttacttaagcaagaataaattaattgtgtgatatgtatgttgttgagtcgaagaatttattgatgttaagaagaattttgggtgtaaacatagttagttttgatggagaaaataagaatatatgttgaatttgtatggtgtattattaaaaagtaggctcctgttgggttctgctatgtatccatctcctgctattttgcgtgaatcaattcaactgtctggtactgaagtagtaacagtatctttatctaggcaaatgccatctgaaaatggtggtagtgatttttggaatatagtaaaaaaaagtggatgtcgtattttacctaatactgctggatgttgtacagtaaatgatgctgtacttatgtctcaaatggcaagggaaatttttggtactaattgggtgaaattagagctaataggagatgagtatactctatatccggatttagtattattatgtgaagctacaaaggagttaattagtcagggatttgaagtatttccttattgtacagatgatctagttgtttgtaagaaattggtaaattatggatgtcgtgtgttaatgccaggaatatctccaataggttctggatgtggtgtactcaatatgtacaatttaaagttattaagaaatagatttccagaaataacaattatagctgatgctggtataggtaggccatctgatgcagctatgataatggagattggctttgatgctgtgctgcttaatactgctattgcgaaatctattgttcctcaagatatgtctcgtgcttttaaatatgctgtggaggctggacgtatagcttatgattctggaattattcctaaaaaagactttgctgtatctagtacaccactgattgatacacctttttggtataacacttctagttaaatattgtaaaattgacgtttttgtttatatgttgcagcatttattagtaatagtgcttagttagatcaagaaattggcatatttaaatcaatgtttataataatacttgagaatatatgtaggtattttgttataaaatcatacattataaagagtagattaatattgaggtggagtatagtttagtattattcattattatgtgatgttttactatattatgtaggcttttgaatgtacctatctcttaaactttagttttgcggaaattaggttttctgcaaatataacatcgtgtatcttatatcccatttttttcaattttgcttgataccaatcgggataagatgaagctatataaagtgaatatagcaaattcactgataagtaaattggtaagttaataaggtttagtgtgttgtacattatataaattccactaagtatcacaattgaaataaatgataaaagccacagcttgttgtaaaatgtgaaaagaattgaaaatataaatgccataaatgagaactcgtcttgcacaaacactatgccatctgaagtattaattttctttgggtgtttatatataatgaaagattgcatataaattatatagtttgctgctctacatttaatagtatgattaaaatagaagttagtaaacctaaaagtattgcaatgcttttttaagttagtaaatttaaaatatttttgtatagctatataaaaactgtgtacgatgttatcagaattttgtgtaatatgtagcatttaaaaatagagtattagtgatttgattgtgtcaattaatttatcttgttcatattatttatttgtgtagtgttgaattttaggagatcttggttatgattacacgttttgctccgagtccgacaggatatcttcatgttggaaatgttagaacggctttagtttgttggttatatgctcgtaagcaaaatggtaagtttttgttaaggtttgatgatactgatactcagaggtcgaaagacgagtatataagggaaatagagaatgatttagtgtggttaaatataaattgggactctagttttagacagtcttctagatttgaccgctatgaggatgtgtttaattatctgttgaaggaagggttgatatatccttgctatgaaagcaaagaagaactcgaatttaaaaggaaaatgaaattaaagttaggtttaccgcctatttacgatagaagtgcattgaatctaactcaagcggaaaaagataagtattctgaaagagctccatattttagatttaaaatagatcagaatcagttaataagctggaatgatgaggtacgtggtaaagtatcatttaactcagagaatattagcgatccaatcattaggagggttgatggaacatatacttatatgctgccatctataatagatgacatggattttaatgttactcacataatacgaggggaagatcatataagtaatacagcagttcaaatacaaatgttacatgctttgaaagctagtatacctatattttcgcatttgtctttactgtattctgatgataataaaatatctaaaagagttggtggttctagtgtgaaagatatgcaatcttatgggttagaacctatggctattaatagttattttgctaaaataggtacttctaatccagttagtgtacacacgagaatgtgtgggttaatagattcttttgatattactacttttagtcaagctccaactaaatttaatatagatgatgtattaaaattaaatcccaaggtattatgtagtatgtcttttgatgatgtaagaaataggttacagtcatttaatataacttctccaagtttttggaattttgtatgtgggaatatagacaaattctctgatattgaaggatgggcaaaaatttgtagtggggatatgatacctgtgattgggcaagatgataaagattttatcatgttagcactaaatatgctccctcagggagaagtacgtgataatacttggaatctgtggatttctaatataaagcagcatactgatcgtagagctaaaaatttatttactcctttacggttagcgttgactggattatctacaggtccagagcttgcaaagttattgcctttgattggtagggtggaaattgtacgtagacttagttattctgaagtacaataaattattttattactgagtgtcttaatataatgtatttctatgttgtatttgatcatttattgtgataaaagtaagagatatttctttaattcgatggcgggtgtagctcagttggtagagcgtcagtttgtggcactgaaggtcgccagttcaatcctggtcattcgcccatagctttttagtggtttataaactgcactcttgattataaaagtacttttgtgctaaagaatgtgtgtgtagttttatatttagaaagtttagaaatagtgtctttacgtctactatgttattgtatatagtcgctttttaaattgttcaaatttttgcttagggtttttatcattagtgatctaactaatatgtttatttttaagccagttactattttccttatagaagtgttactctgttaaagagtctttgacattgttgtatttttatataaagttgattaagtaacttattaaatacaattcatatgtttaatcatgcagtaaggttgttggtcttatttattattttatatagtagtaatgtttttgctagtgtaaagatagtagctatggtgaatgatgaattaatttctaacttagatttagaaaagcgtattgctataaataagtttttttataaagttgaaggtaatacagcagaggaaatagctttaaatgctttgattgatgaatctatatggaggcaagaagctagaaaacttaaagttacagttactgaaagagatcttttagaagctattaaacagtttttagtgataaaaaatttaggtaatattgatttaaagtcttatgttgaagcacaagggttagattataagttgtttgtacaacatatgaaatctaagctgctttggaataaaatattaatgcttaaaatagcgccttatattattattagtgataaggaagtacaagatagtagggataatatggtgggtaatggactagatatatctgtgcatattcaagaagtaatgctaccagctagcatgaatgacaatgagtctataataagtagtattattagtgagttacaaagtggagtaagtgttgaaactataaaagctaataggaaagatgtgttgtttgaagaagcaagtgttaatgttaaaaatattgatgcgaatttagcaaataagttacttaatgctaagattggggatgtgataggtcctatgaagagtgagtatgggactttaattataaagttgatacataggtctgatataaacaaagagtttgcaaatagtaatgttgatttaaggcaaatgcatttaaatattgagcagggtaaggagtatttggatcaaattagtatattaaaaactaaagctacgtgtgaaaattttaatagtgtagcaaaagagcttggattacctgagccgttaagttttgtaataaaagtgaaagatttatctgtaaaaatacagaatgttttacaatcttgtgatgttgggaaggtagttgaagtgactgataataacgtagttgacgttattatgttatgtaatgttacaaaaggtaaagctgatgatgtggtagataatgctgattttatcaaacaaaggctatacatggaaaaattgtctatgcaaagtgaatatttattatctactttaaaaaagaatgctttaatagaaaaatataattaattgtcatgttacgtataacgtcagggaaatatcgtggtaggagaatattttctgataaactgcttagtgctcgtcctgctatgtctataattagagagtctatttttaatataatattatctcgcatgagtattcaagggtgtaaaattcttgatttgttttgtggtagtggatcattatcgtttgaggcattatctagaggtgcagagagtgtgttattggttgatataaaccactataacttaagtctagtaaaacgaacatctgagtatttgggagtagtaaataatgtaactcttatgtgttgtgatgtcgaaaaattacctcttgcaactgatcaatatgatattgtttttgttgatcctccatataccaatcctaatttagttgatatgactcttaatgtactaataaaattaaactgggtgaaaagcagtagtatagttgtagttagaatcagaaagaaagtggtttttgtatgtcctataggatatagaataatggttgagcgtacttatggtatttcaaaagtaataatgctgcaacgtgagttttagatggttatattaatatagtttattgaactgctatacagagctttatgcttattgtgtatgggttgcaagtttgtaattttaagcatgactattggtataacttgttcatataaatagtactaaaatcattagtataattaatagtgtgtcaatcaacatgtaatatacatctatattatttagggttgtagataatatttatatgcttactattgttggtaacatattacaattgttagtatatatcttgtaatatggtatagtatttagtaattgatattgaataatggtgtaattgtttagcgtgcatctaatattacatactagtgttaatatatatacttttgatcttatactgtataaaacttctgtatttttataatattaatagatataaacatctgtgtatattctttaatacagtagtattgaaatcattattgggacatagaatagtcctataattgtatttactaataacatgattgctgttttatcagggttattgtttaacatcgtagctaatattatacctgtacctgacattgggattattgcgagtaatattagtgctctatatatatcattgttatataattgtatggttaatttgtctaatataatgcacccaagtactaacactggccacagtacatattttattattaaggtaatagaaatcaatttccagtcgatggagaaagttttaatgtttgcaactgctatccctaataacatcattcccaatgaaacgtaagcacctctaatattacttgcaacatcatgtacaaatgaaggaataggtattttaaagtagttgacacataatgccattacagctgcatgtgctgcaggtgatgttattagttttattatgcatttttttggagtatatattccttgagcagcaatgtaaaaaccaaaactgttttcaaacattaacatacctacataacagaaaaggtatatggatactgtgtgattatcaaacattgctaatgctactggtagtccgaaaaaacccatacttgaactacctgagctaaatgctagtatatttcttgtgctatctctgaatatgaaagaagaagtatagtatactacagctgacatgatacaacagacaagccatgttaaaaaaggaagagataggacttctgagttaatgtttgtttgtgaaattccagaaaatataacggttggacccattatgtaaaaaagcaatctagctatgctaggactatctattttgagaaatttgccagcgataaaccctaaaagtactgttatatataaaggtaaaattttagatagtaatataaaaaacataatttttgtagcatgctattagtgtatgaaatactgtaacataagtgtgaattactttacaactatagaatcatgaaaaatgtgtttataagtaaaattttagttgtcaagtataggtcatttatttagtaacataataaagggtatataaggataaatggagtaaaatagtagttaataattttcttattattgcaagttgtgtgggaactataggaaagtataagtatagtaattttctgaggtttgtcttatcttttattcatattgtatttttatacaggatgatacccttttatagatcagtatgcgtaaatgatttgttgtgttgtactgatgttatttattaagtaataatttacttatttcttgatttgttttctagtggtggactattataagctgattgtgttaatttgaaatcttattacttgagctttagcttgtacattttatagtcgatgtttatagtgtgaaaatagggttaacttcttcttacatatctctgggttttgtaaaattatcagcgtaagattttggaactatggtgcgtgggttatcttgtaaaacagtataatcaattttatgtgctactgcatatgcaattgctagttctctagttgtaaatgataggcagacctgttgtttagtatcatgtgacccagtccagttcattagtggttcggtgtattgagtgcatgaaggttcaaattcaagtttccacgcttttaacttactatgaccagattgcatggtactttttgctggtttatatattctagcacgcacgttcgacacttgttcttgcataaaaaaactattattatgttaaatatatacagtaaatagtaacttatgtctattaatgatgagtataattttgaagctgctatagagcaactagaatatatagttaaagaattggaatctgacgaagtaactttggctagaagtgttgaattatatagtcttggtaaagaactgtatgagtattgtaataaaatcattgaggatatagaactgaagatagaaatcaaggaataaggacaaggaggaataaggatatgtctctaattctgttatgtatgtaactatgtttgtgttgttataataaaaatagtgtatgcctaattatcatgaatttaatttgtgagtataatgctttagtgtgtttagaaaattaattagaacttcttaaagttatatcaagtatcttgtataagaaaaaatttcttgttgtattaaactataaaaaaatttgtgttttaaaaatattagaacattggatgttgtattggttctatttggaatatgtgtcatcaatgatagtttataggttttttaggatagattttactttgataggacttcctgttattataaatgatgaaatttgtagaaaagctactcatttgttacattgttaaattagttattgctagatgcaaggtttatggtgcttttggttatttaattaatgtttctatagagtaaatagtaatttattttagggataattggcaaaaaaaatagcaattaatacgtatttgttagttgtcttgatttttaattagaagatatcatagttatatagggtatgctggttgatatgagttagagagtcgtaatgagtgacgtaattacctttggatgtagattaaatttttatgaaagtgaagttataaaaaataacttaaaaaaggctcagttggatgatgttatagttgttcatagttgtgctgtaactaatgaagctgaacgtcaagtaaggtctaggatacgtaaactttatagagataatgctaatgttaaaattattgtagcaggctgtgctgttcaattaaatcctgagttatatgttaatatgccaggagtaattaaggtattaggtaatcaggataaacttaaatatgagagttatcttgctaaggataaaattattgtaagtaagatagagaattcaaaagaagttgtgcaagattcagttaaaggattttctggcaaatctagagcattaattgaaattcaaaatggatgtaatcatgaatgtactttttgtgtaattacaaaggcaagaggtaataaccgttctctatatatagaagacattatcactaaagttaaagcttgtgttgataatgggtataatgaagttgtgtttactggggtagatataagtgattttggattagatatttatggacaacgtgttcttgggacaatgataaaaagagtattgagtgccgttccacagttgcgtagattgagattatcatccatagatgtagcagaaatagaggatgatcttattaatattattattaatgagcctagatttatgccacacttacatctaagcttacaatcaggaaataatttaatccttaaaagaatgaagcgtagacatagtagagagcaggtaatagagttttgtaataaaataactagtaaaaggaaagaagtagtatttggggctgatattatagtaggattccctacggaaactgaagagatgtttaatgatacagtgagattgatagaagaagcaaatatttcttatctacatgtttttccatattcaaagagagaaggtaccccagctgctagaatgccacaagttgtacaagaagtgaagaaaagacgtgtaaaacacttattagagtttgctgagaaaagattgcatgatttttatagtactctgttacatacaaagcaaagtgttgtagttgaaaagtcaggaactggtagagcagaaaattttgctttggtgaaatttttggatgataatgttcaattgcaaagtattgttgaagtggaaataaaaagagtagaaggcaattatttagtaggtcaggtatttgtttagtaatgtctaattttaaaactaaagcttctaaatgtatactgtgctaattctttttttgtgtgtctataaaaataaaacttaattttattgtgatgaagctttgatgaaagcttattagtagaatctaaatttatacattgatataattgttatattttaaagctaagtaggtattgaaaattataagaatataacgtagcttttttagttatgtttatttgatgatttatgcataaaaaagctaatatgaagttgtgtactgtactttaaaactacaattttgctaatgctacacttttgtacggtgtgctcaaattagaaaagtaaatacacacgactaagttctctgtagttgccatttagttattgctgtattatctacaaaaccctagtttatattgttatttatttcactaattatctttgaaatatcagctccaataacttgtgataactttttcccatttttaaacattagaatagttggtattgcactgactccatattgagtagctacgtcttggttatcttcgatgtttattttgtatatctttacattttcagtgtattgttgtgctagtttctcaagttggggttctaaactcctgcaaggtccacaccatggagcccaaaaatctactaaaattaaaatattgtcattacaagatgtaaccttgttatcaaattcactgtctccaatttgctcaatcattacttgtcccatttttataaagctatctaatgtattgtaaaacagttataaattatcgcaagaataatgataaaaatataatttgttcaatgaaatgttaatttgctaaatatattttaaactataattgacttatcagctttttgtgaacagcatgtatgatgaaatataagtccatactgtcttttaataggtcaatagtgaacatatgtatacaaagttaatatagcactaaatatgcaaatttttaaatagaaaatgataaaccctacctttttgttttcttgtatttgttattaaatacgcatactgtgtctgaaccatagcgtaaagtgaatgcgctactaactcgttcaataataacataatcacctgatactctaaaattaatcaatgattcatatccttcagaatctacagtaaatattgatggtaaatctgcattaatttgagcaaattgcatataagtgaattggttatcgtcaaaaattttgagtggaacaattcgttgacttcctctattgtgtgatactaaataatcaaaatttagtcctttttttgcaacatcactgtcagttaagtctggtatagcaggttggttaactggaaacaccataccaggactatcttctgaaataaagtcttcagtagaagaatatacaaaccttacttcataggctaatcttggatcatcgagtccttgtgcttcttctgcaaaaaattcaaagtagtatacacgcttgtttgtaattattgttgcatttgtatctgctttgtcggctacaggtttaataaataatctattaccttttggcattagttgccatcctgttgaatcacccatagatatggtgtcgatatcttctccatcgtcaaacactatactagattggtagccgtaaaaccctgtgtacttatgtacagcatggggattgtaagtaataactttgatatgattatcttgtgctatagaacgtacttcttgcttagcaaaacagactgtactgctgaataaaatcaacacaaaaattattgctacgtttttcatctgtagtttgtagtaaaatgtacaacgtttcattctaacatcaatattggaacttgcaacaaatctatgcgaatttagtatgtaagattagtaatactgctgttaaaaatttgttaagcttttgagaaaaggtcttttagacattttattggtagtttcattgatgtttgtactgtagcttaacaaatggcacttttctattttgcaaattagtgtatagaatttcgatatttacagacttgaaatagtagatgagtttaccctgattttagtacttcagtatgtaaaatttacctagagaagttgttactatacttaaatatatcaatctttataaatgtcagtatacagcattttagcatcaggttcactactgttttgtgaaaaatctacggattcttttactatgttacgtatttctttgtcatatttattgcattcatcatcagatataatgttgttagatattagatagttttttaaattggtaataggatctttatgttcttttatttcttctacttcctgttttgaccgatacttagctggatctgacatagaatgtcccctgtagcggtaggttttcatttctaataatattggaccattgtttgctctgcagtaatttactgcatctgttgcagcttgtgttacagaaaataagtccataccatctacttgatgtcctggtacaccaaaactttctcctttcttatataagtctgttatataagatgatctggatacagatgtacccattgcatattcattattttcaattacatatattactggtaatttccacagtgcagccatattgaaagattcatatacttgaccttggttcactgctccatctccaaggcatacaaatacgacattgttattttttttgtatttgttggcgagagcaatccctgtccctataggtacttgtgctccaacaataccgtgacctccaaaaaaatgcttttctatgttaaacatgtgcattgatccacctttacctttggaacaacctgtgcttttacccattaattctgccattacatattttggatctgttcctacagaaagcatgaacccgtgatctcgatagctagtaataatagaatctccatcaataatagcattttgtattcctgttgctatggcttcttgtcctatatataaatgacaaaaacctcctattaaacccattccataaagttgaccggacttctcttcaaacctgcgcattaatagcatgctgtagtaacaatttactagctgttcatttgttagattatgtgaatatttttttgtcatgtattacctaaaatattaatgagcttaatacctgatatatttaatcagtgacattagttgttttatatcaaaatattgctaacttatttattagtatatcgcaacaactaattatgtattaaatattcatacgcattagtataataaaaatagatactgatattagtggtacgtattagtttatttatgtagctagtttttgttgtaaactagcttaacaaccaatttcttatatcctggatttggttattactcataagtgctggagcatgacctatattaggatattctataaaatcaatgtattgctttgaaagaagcattttgtttaatgtagtttttgttaaaatgtttgataagcttccacgtattactaatatcctgctctgtattttttcccatatatcccatatagtccatgcatcagtatcttttatgcaattaatttctttattaaaagctatacctattttaggatctactgctaatgagtaagtcttattggggttttgtataatgctatgcttaataatgtgttgccagtgatcttcttgatctatactgaaattacataatagcttttttatatatatttctgcttcagtaattgtgttaaatattggattaatgtttatgtgtttagaaattttttctaaagctgatactttaatagctggtccaatatcgttaataatgagtttattgattaagttagggaaatatgcagctaaatacatgccaattattccacccattgaggtgcctaaaaaatctactttatcaatttttaaatgtttaagtaggtatattatactcttgcagtaggttaagtaattgtacaggctatagtcctctagccatgagctttttcctcttcctacaatgtctggacatattattttatagtcagatgataagatatttgctaaatagtcaaaatctcgagaatttcttgttataccatgaacacatattaaataattactgctgggactgttagtataattatagtgcattataaatttttcttggagatgacttatatttaatgtatagggtagcataaattaattattataagttgatttaaaatgatattttatgcatttttaaaataagattcaaaataataaaaaataagtattgacatagaatgcatatgccgttaaaaattatatctcacgggatgcataatgtatttatgtatctttgttgtttgacaagtaagcaaaaagaattaattaaatggtaagattgatggtattaatcatcaatcaattcaattagctaagagtataataaataaatgcagttttaatactgcatatatagcaaatgagtaaataataaagagcatttgatggatgccttggcgttaagaggcgatgaaagacgtggtaggctgcgataagctgcggggaattgtcagacgaattttgatccgcagatttctgaatggggaaacccaatcaatttattgattattgcatactgaatacataggtatgcaaggcaaacctggtgaactgaaatatctcagtagctagaggaaaggaaatcaaaagagactccgttagtagtgacgagcgaacgcggaccaggccagtggtctgtagttaaaaattagaatactttggaaagagtagccatagatggtgatagcccagtataagtaaaaagattatagatccttgagtagggcgggacacgtgaaatcctgtttgaagatggggggaccatcctccaagcctaagtactccttaacgaccgatagtggacaagtaccgtgagggaaaggtgaaaagaaccccaggaggggagtgaaatagaccctgaaatcgaatgcttacaaccagttggagccttatatttacatcttgggagcaatcttaatatgtatttattgaggtgacagcgtaccttttgcataatgggtcagcgagttaatctattgagcaagcttaagccgttaggtgtaggcatagcgaaagcgagtctgaatagggcgtttagtttaatggattagacccgaaaccaagtgatctaaccatggccaggttgaaggtgtagtaaaatacattggaggaccgaacctgttactgttgcaatagtattggatgagttgtggttaggggtgaaaggccaatcaaacttggaaatagctggttctccgcgaaatctattgaggtagagcgttgtactatatacttttgggggtagagcactgaatggactagggagactcatcctcttaccaaatccaatcaaactccgaataccaataagtagttatacagcagacacactatgggtgctaagtccgtggtggaaagggaaacagcccagatcgccgtctaaggtcccgaaattgtggctaagtgtggaaggaagtgagaaaaccaatacagctagtaggttggcttagaagcagccatcctttaaagaaagcgtaacagctcacttgtctaaataagttttcttgcgccgaagatgtaacggggctcaagccatgtaccgaagacgcgaattcctaattatattaggtctggtagcggagcgttttgtaagcctgtgaaggtgattcgtgaggattgctggaggtatcaaaagtgagaatgctgacatgagtagcgtaaaagagtgtgaaagccactctcgccgaaaacctaaggtttcctgtgttaagtcaatctgcgcagggttagtcggatcctaaggcgaggccgtaaaggagtagtcgatggaaatcaggttaatattcctgaaccttttaagcgtgacggattttgtgttagtgtgagccttattggattggctcatgctttgaaaagatcccaggaaatagcgcttaagtttataagtccgtaccgtaaaccgacactggtaggtaggtagagtatactaaggcgattgagagaacgatgttgaaggaactcggcaaattacacctgtaacttagggagaagggtggcctatgtgtgggcaaccatatgtaggtggcacagaatagggggtagcgactgtttactaaaaacacaggactctgcaaacacgtaagtggaagtatagggtctgacgcctgcccggtgctggaaggttaacatgaggggtgcaagctccaattcgaagccccagtaaacggcggccgtaaaactgacggtcctaaggtagcgaaattccttgtcgggtaagttccgacccgcacgaatggcgtaacgatttccccactgtctccaacatcgactcagcgaaattgaattccccgtgctgatgcggggtacccgcgggtagacgaagagaccccgtgcacctttactatagctttacattgatgttaggaatgcaatgtgcaggataagtgggaaactttgaagctggggcgctagccttagtggagttgaccttgagataccactctttacatttttgatatctaactatgccccatagaatctggggttaggacattgtatggtgggtagtttgactggggcggtcgcctcctaaagagtaacggaggcgtgcgatggtaagctagagctggtcagaaatcagcttttatagtacaatggcataagcttgcctgactgtgaggtcgacagaccgagcagagacgaaagtcggtcatagtgatccggtgattccgcatggaagggtcatcgctcaacggataaaaggtacgccggggataacaggcttatggtgtctaagagttcatatcgacgacaccgtttggcacctcgatgtcgactcatcacatcctggggctgaagtaggtcccaagggttcggctgttcgccgattaaagtgatacgtgagttgggtttagaacgtcgtgagacagttcggtttctatcttccgtgggcgtttggaaatttgagaggatctgactctagtacgagaggaccgagttggacatacctctggtgtaccagttgttgtgccaacagcatcgctgggtagctaagtatggataggataattactgaaagcatctaagtaagaaaccttccttaagattagatttccccattagggccgtgagagactatcacgttgataggctgggtgtgtaagtatggtaacatatgtagctaaccagtactaatagcccgattgatttacttattttgtaaatatatgtagtgttaaaactgcaaactcatctttttgcttacttgggatttatagtttaattgggttggtggtaatagcggaagtggtacacccagcttacatttcgaacctggaagttaagccttctagcgctgatggtactttgtcttaagacatgggagagtaagtcactgccacccttattaagctataaatcttgatattatttgattaaaaaagtcttttgtaagatggactctttattagttaagctcccttatttacttttcctgttgtaagtatatctttttataattgatgatgttttgtgttgatatatgactgtttaggtcagtgctataaactataagctttattaatttaactttaaaatttgtgtataatgttattgtcaaaattatatttttaagaaagttttagtaaacggtaaaaaacagttcgtatctgattattgcgttttttgttgattttattagcatttttatagattttctttcttataaggtatatgtacactatttttcaggtgaatatgtaaggttttgcttttttaataaaagtattattctgttaaagcatatgattatggggtaaaaaatccttttaatgaaaataagagaaagatgtaataggctttaggtttcttattgttagatttttattaagtaaatgttttgtgattttttattaagagatagggtcgtaatttgatgcttctctggtgattattacgtcatgaacgtgactttcgcgtagccctgctgatgtaatacttgtgaatttacaatttgttttcatttcgcttatatttctgtttcctgtatatcccattgcagatcttaatccacctactaattgatgtattactcctgcaactggccctttaagaggaactcttccttctattccttctggaatgaatttgtgattattttcttggaaatagcgactagcggatccacgtttcattgctccaactgatcccatacctctgtatgatttatatgcccgtccgttgcatattatgatttcccctggactttcatctgtaccagcaaaaatagaacctatcatcacaacatctgctcctgctgctatagattttgctatatctccagaatatttaatacctccatctgcaatgactttaatttttttatttttacatgcatttgcaacattgagaatagctgaaaattgtggtacacctactccagttacaattcttgttgtacatattgagcctggtcctattcctactttaacagcatcaactcctgcttcaattaatgcatgagctccttctgctgttgcaatgtttcctccaattatttgagaataagggaatagggttttaatttctttaattgttgttaaaactttttgggaatgtccatgagctgtatctacaactattatatcaacatcttctgcaattaatgcttcagctctttctatcccatcttttggacctgtacctactgcagctgctactcttaatcttgcaccactatccttgcaggaatttggaaattgattaaatttttctatatctttaactgtaataagaccgacacaacaatagttgttatctactactatgagtctttcttttctgtattgatgtagtaattttattgcgtctgaccgttctataccttctgggactgtaataaggtgatccttagtcatgatatcagatactttacaatttttattttcaacgaaccttacatcacggtttgttaatatccctactaaaagcttgccattttctgtatctgttactacaggtattcctgaatagctatattcctgcattattgaaagtgctactgctagactgtcatcaggagatactgcaataggattatatactatccaactctcgtatttttttacttttctgacttcaagtaattgtgtatctataggtaaatttttatgtatgcaaccaatgccaccatgttgtgctaatgctattgctagttttgcttctgttactgtatccattgctgcagaaatgatagggattcgtagttctatctcatttgtaatgtaagttttaacatttgtttctgaaggcaatacatcggactctgatggaatgatcaatatatcgtcgaaagcataagaaagttccactttttttccataaaagattacttatagagtatatgaacttttagttattcatgcaatagtattactaaatataatctttttaagcagagaattgttcattagttattcgttcttccaaattgcgttctttatcgaatagtaatgtaatagtagtatcagtgtctttcttgatttttatatttgtaatatttcggaattctgtatagtcagcaactgctgctacagaacgtacttttggattaattacatctatttctattatagtagaatttgttaatatagctcctctccatcgtctaggtctaaatgagttaattgcagttaatgagaagacgttagaatttaagggtaatattgatccgcctgcagaaaaattataagctgtgctaccagctggtgttgcaactaaaacaccgtcagatactagcttttccattactagtttgctattgatttttatctgtaaatttgtagcttgatgagtgctacgaaatagagatacttcatttatagcaattgcattgtactgttttttgtcagtatcggtagcaaccatatttaatatggttaattgggttggaattgcttcgttgatacgatctataagattatattctgaatattgatttaataaaaatccgatggtgccatagtttatcccataaacgggtacattgttacatttattcacaacgtaattgtgtaaactgtgaagcatgaacccatctccacctattactattaatagatcaatagctatatcctcattttttttgatgtctataagaccatattgcttttccaatgcaatggctgcagttttatcaaaagcatcagtaaaaacatacccaatgtttttatatttactcatgtgcaactacaagaatgaatatacatacatatgttatatagtatataaaataagatttataaatctaaatcaccaaatttactcataaattttgcagctttactatttttcttgctaacagttcttaagtttggattccatgctggatggttaaagcagtcactttctaggtgaatttttattagttcattcttttttcccaaagtagacttcatttttctttcttccccattagtaaatatggttaatatgtcattggtttctggatgtatcccttttttcatttttgaacctttttgaattttgtaattatgtcgtttagcaaacctattgttgtaacatttatgtatgctatttgtcaattatatatagggcttttaatggttatgtaaattcttttgactaatttaccataacagtatatcataaaaataggtagacagtcgaggatatatacagatgatttttatgtttcctggtcaggggtctcaatttgtgtctatggggaagaatatatatgacaactttgctgttgctcggtatgtttttcatgaagtagatgacatattgaataaaaagttatctaaaataatgtttgaaggttctatcgaaaatttaacttcaacagataatgcacagttggcattgatggttacttctattgcaacattacgtgctatagagtatgttttaggtaagccagtacatttatttaataatataaagtatatggcagggcattcggtaggtgaatgtgtagcattgtgtgcatctggagcattaactttgtatgaagttacacaacttttgcttgtaagaagccaagctatgtatgatgcagtgcctctaggatatggagggatgtgtgctttaataggtggcagcttaagtgatgtagaaaatgttgtgaaaatggctcaagagtatggaatatgtgaaattgctaatgataattgtgatggtcaggttgttgttagtggtgttaaagccgctcttgaaaaattgccagatttaattaaagatactggtataaaaaaagttataaagttacaagttagtggaccattccattcatcattgatgagttctgcgtgtgagaaactacaggaatttattgagagtgttagaaatatgaaaatgccgtcagttaaggttgtatctaatgtatctgcaagagaatatactgattgtttcatgattaagaatttaatagcgaaacaactagtaagtagagttcggtggcgtgaaagtattttgtacatgataagtcaaggttgtactcactttattgaagttggtgctggtactacgttgtcaggtttggtgaagaggattagttcggatgtttctgcagttagcattaacacggcagattgtatagattctataacgcgacatttcacggtaagtacggatcttgttgatgcatagatatagtatatacttgtaactatctttgttattttctcctacagtttttaattatatttttgtgcagtagttttagctagaaatttttaggttactaaagtttttaagctatttgaggtaatgatctgcataagttttgtaaaaagtgagtttattattgcttactttataaggtataagtgacttaggtatttttacttgcatgtacttgagtaattagtaataaagttgtttgtatctaatgtaaggtaatttatgttcattacttttgaaggaatagatggttctggtaaaactacacagtcacatttgttggcggaatatttatctgaaatatatggtgtgaataatgttgtgttaactagagaacctggaggtactttattaaatgaatcagtgcgcaacttattatttaaagctcaaggtttagatagtttatcagaattattattttttattgctatgcgtagggagcattttgttaaaattataaaaccttctttaatgcaaaaaaaaatagtgatttgtgatagatttatcgattcgacaattgcatatcaaggttatggacaaggtattgattgtagtttgatagatcagttaaatgatcttgttattgatgtttaccctgatattacatttattattgatgttgatattaatgaatcattgtctagatcttgtaaaaatggatatgaatttgctgatatggaattttattatagagtcagagatggcttctatgacattgcaaaaaaaaatccgcatcgttgtcatgtaattactgataagagtgaaacttatgatattgatgacattaactttgtacatttggaagtaataaaggtattgcaaatggtatgaatttgtgtgtaggatctacaccttgtttttttttataattttaatggttttaaattaatcatgggggatgttttgaatagaaaatttttagcatggtttttagtctcaatgttttatgcgtatcagtatatattgagagtaattcctaatgttattgtctctgtgtctatggagaagttcaaaattagtgctatggcatttggtcaattttctggtttatattatattggatatacgttagcacatataccgctaggtattcttttagataaatatgggcctaagatagtattaccaatttgtgcagctctaacgtttattggattagtgccattgctaatatcagatgtgtggttatttgctcaaattgggagaataattacaggtgtaggttcagctggttctgctcttggcctttttaaagttgctagtatgtactatggcaacagatttgctagaatgtctggtatttctgttataataggactgctaggtgcaatgtatggaggactgccaattttatctttgttaaataaatttggttgggaaagtttattcttagtatttattattataggagctgttatagcgctgttgctatatttgtttatgttgccttatgataaagactccaatgttgaagataataaaggtctctgtgataaaattaagttgattgtatttaataagtacattgttatgatcagcttacttgcaggctttatgattggacctttggaaggttttgctgatggatgggttacttcatttttaaaggcagttagtaatatggataaagaagtagctgctttattgccttctacaatatttattggtatgtgctttggattgtttgtcttaccatatatgttggagaagaaatcatttaatagttggaatatacttatcacatctgctttggggatgttgtttcctttcctgatgttatatatcagtagttcggttatattggtcacaatatcattttttatgatagggtttttttcatcatatcagattatagcaacttgtaaggtactaagttatgttagtaataatgtagttgcattagctactgctgtaaataacatgatagctatggcttttggttatttctttcatactgctatatcttgtgtaatagatttgttatgggatggaaaaattgtagattcagagccagtatatactaaggcattaatgctaaaatctatgttatttattcctggtggattgcttataggagcaatagggtttatttacctgaaatatttggataagaaagagggtaagtaacacatggtactacagttatatataatcatgtatcgattatatataactgtgtgctttgataaaacgatattagtttgtatagttttttgtgatttaaaacgtcactctaagtttaagtatagagtttgttcttacttatgtgttctaagtagaaaagctaatatctacaacaaatagtttttttcttcttatttttagtaatcaataatttaatataagctatgcgactttttatatactttgattttaaagtattagaacatagattgtaactttaaagttaagataataaagctctgttccagtttttgctattgttaataatctgatgatttcaattaaagttgtattagtttttgactgtttgagatgtgaatttagtaggataatttaaatttacagcagtaaagttatatattttgtttctagtgtttatcagataatttcataatggtgtatcatgagttctatgtatattttaatataatatactttacaacaaaactttttgtaaattctaagataggtatgtcagattatacagattgaatagtactgagataccattttttatttgaaagtgttgtatctttcctaaaggtccatgtgtcttcaatcttgttaatttttgaagtactaccctgtaggatattatcgtccttgtcttttacaaagtttatttgttcgctaatgaattttactgttatgtatgctatattaccagaaagacttaactttgttattttgtgggatgttattgatacaataatatcttcatatagttgaccaagtgctttacgattttctatttcttctacgaatgaattatataaattagtatctaatagcatagataatatgtgtatatttccttcattgaaagcttttattataatttcaaatgcctttattgacccatccatgaaatgtcttagagaaaattctttgtctttctttttaatatggttgatgattgatttatcattttcgttgcaaatttccattacggaatctatgtcaatatcggcagtgtcatgttcttgtgtgtcttccataatgatacttatggtttgtgaatgactgtttgattgtaaccctgaagtttttccaagagagtgatataaacggaaaaagatgaatgctgctaaaaatgcatatattgctaattcaaccatataatcctaatttttattgacaaaaacatatactgtgtatactcaatatattatagcttagtgtacgttaatcaataattaattacattattttacttgggggcttgttagtatgtcatgtaaattgaaagttaagggtcaatatattaaggatctttcatttgaaaatccgaattctccacaaatttttttgatgattagtaaaaccccacctgagattaatatttctattaatgttagttctgtaagtcttccagtaaaagcacaagatcagagtagtgaacagccttcagataataaagtagagccgttatatgaagttactctacaggttaatgcagaagctcgagttggtactacagtagcatttatttgcgaaattaaatattgtggtgtattctctattgaaagtgatgatgtaagtatagaggaattaagtcagcaagatataagagatgtattgttgatttctgctccaactatcctattcccatttgttagagagttgatttctagagttacttctacagggggattccctccgttaatgcttgatattgttgattttagagctatgtatgaatctcagatgaagcagggtgttggacagaatgataatagtcaggatccagaaaaatagggttttgttaaggataatttagtttgttagttaggacagcttatagtttgattagttaagttaatacaggtttttgtattatgaaatgtttagtgataagtaagctattctttttgtttgtagtagttttcttctttaattttgcattttgttctgataataacaaacaagagcctgaacaaaagttttattctgatactcttgtaaaattagatgatgatatcactgctcaagagttattgagcttgttgcctaatgaccgttttataggtaatacaaaagctccggttatcataatagaatatgcttctttttcatgtatgcattgtgcacattttacactaaatgtttttccagagttggagcgtaagtatattaaaacaggtaaagtgttgtatatttttaggaactttcctttagattatatatcattaaaagctgcaatgttaggaatttgttacaatactgctagtagcttttttacttatactaaggcagtatttagctctatagaagcgttagtaactaattataaggatttgggtgtattgtctaatattgcaaaaattagtaatgttactgatgaaagatttgagaagtgtattaatgatgaagatataatgaattatattgtgcaggagaagtttgttgcaaatagaaaattacaggtaaatgctacacctgtgttttttattaatggtagaaaatatgataagccccatgatattgaaagcttttctgaaacaattgatgaattaattatgttgcatccaaattattcgttagtaggtagtaaaccttaaatctgtagaatttatcgattctatgttcaagtattgtctgtctatttaaggtataagaattgcaactaagaacttttttgtagtattttttacttctaaatgtaagtctgttatatgtaaaacatttgggctatatcatcataagaaggtaggttttcaatttgacctatagctgctaaggttattttgttgttgctacctagtagattattaatacagttctgaatgtctgtgactgtaattgtagatattttctttattaattcttcttttgaaatgtaccgattgtaatgggaataatagtaccctaaggattcagcgcgtgcagtagtgctttctcttgacattaatatttcagatgttaatttaccttttgctcttgttatctcgttttcttgtaagtttgttatgatattttttacttcagaagctatagtggaaagtaattgacttaaattacttttatctgttgctgcatatatagagaaaatgccgttatcactgtaacttgagttgaaagatgaaatagtatagactaatcctaattgttcacggattttttggaaaagacgtgatgacatgccatttcctaagattgaatctaaaatttgtatagtataaaacaagtcatctttatatgaaacactagggaatcctatgacaagatgtacttgttctaagtttcttatttctctatattctccgctgcgataaattgatggatctgctattttacgttgtgattttttcatatgagaaaaatactgagatactaaatcaatgacttcttcatgtgatatgtttccagctactgatagtaacatgttgccagcgtgataatattcactcatgtagatgtgtaaatctgctttagataggctatttactgattctggggtacctaaaatggatttaccaaatatttgattaggatacgcagcttctatatacttatcaaaaattatactagtaggagaatcatttgtttgatatatctcttgtaacactactcctttttctttgtatatttcttcttccggaaattgtgaatttagtattatgtctgcaagtacttctatagctattttaatgtctctttttagtgtttttacatggtaaacagtatgttctctgtctgtgtgagcgttaaaatttccacctatatcatcaaaaatttgtgctatatcaagtgcagtgcgagttttagtgcctttaaaagccatgtgttctaaaaaatgagagatacctgttatgtttatattctcatacctacttccgacgtttacccaaatgttgatagatacggattctacatatggcattgtgtcagttattatagtgaaattgttgctaagttgtgtaatttttggtgacatgactttaaataaggaattaatgtcttaagtttatacggttaatgatatgacagcaacaaatataataaaatatcagtgtatgaaaatcatgatttaacctaattttgaagatttttcataactacattttgttaattaattatgatcttgatacattagtacatacaatactatctaaatacttgttttatatatacttttaatggtacattgtggtatgtaaatggtagtgttggttgtacggcttgtttaataaggagcaattattatattcgtaattttcatataaatgctacttattttacaatattatttgtgtaatgttagctaaggtgttaacatggcaaggatttgtggtggattgacggagtagtaagtttagctggtattatcctatatagtgtatattgggttaattttattacttgagtaaaatttaatatttagtggtcatgtattgatttgcattagtaaattataggtatttgtggtttttaccataaaaagtgggaagttatatagcgtattgtgatattgatattgcttgttaaattgcaaaaaaaatgataaaagtgacaggttaggtttctcagctatagtagaaaatgtatagtattgtcaatagattaaggttttaatttgcgtaaaaaaattaagaaggtattgatttccggtaaaagtgtttggccaattatagaaggtggtaaaggtataggtgcgagtgatggtagaactgctggtgcttttgctgctgcttctgctgtaggtactttttctggagcatgtgctagattagttgatgataatggggagcatgttcctttaatatatcgtggaaagactaggttagaacgccataatgagctcataaactatagtattgatgcagcagtgagtcaggctagaatggctcatgagatatcaaagggattgggaagaatacatatgaatgtactgtgggaaatgggaggtgttcagcgggtacttcatggtgtgcttgataaggcaaaaggattaatccatggtattacttgtggtgctggtatgccatataagttagttgaaatagctgctcaatatcaagtttattactatcctattgtttcttcaatgagagcatttaaaattttgtggcaacgttcttatcagaaattttcaaaaacacttcttggtggagttgtatatgaagatccttggttagctggtggacataatggacttagtaatagtgaatctcctggtcatccacaagatccttttgaaagagttgcagcaattcgcgcatacatgaatgaagttggattatctgatgttgtattaattatggcaggtggcgtttggcatttgaaggactgggaatcatggttagataatgatttaattggtccaatagcatttcagttcgggaccagacctttattaactcaggaaagtccaatttctcctgggtggaaaaagaagttgatgtctttgaaacctggtgatgtgtttttaaatagatttagtcctacagggttttattcttctgcgattgaaaatgagtttataaaagagttacaagcacgtaatacacgtcagattgcatttgaaaatgagatgactgaaaaatgcagtgcagagctttctattggtagtagaggtagaaaagtatatgtagatcctaaggataaaaaattgtccgagtcttgggtagcaatgggttatacagatgctttaaaaactcccgataatactttaatatttgttagtcagagtcagtcaagaagtattagggaagatcaaataaattgtatgggatgtctaagtcattgcaaatttagtaattggaaagatcacggggattatactacaggtattaaaccagatgttcgtagtttttgtattcagaaaacgttacaaaatattattgctggggtagaccatgaacatgagcttatgttttctggccataatgcatataagtttgtacaagatgagttttatagagatggttatattcctacaatcaaggagcttgttgatagaattttgactggatattgatattgttttatttgtaaataaaaacaatagttaggtgtctgaagtaaaaagtattttttattattaatcacatagaaattcttcctgtactttataggttttgtggtatttgctgctgctagtttttagtaaatataatatgtgtttatgaaatttttgtttggctgaaagtgtagtagcttttctattagtaaaattaatttgaagtttagcatgtataagcatctatgtgaaatttattgtaatatgtaactatactttaatattatgctcgtatagacgttctaagtgttttgcaagcatgtctacttctatattgatattgtcatttactttgttgtattgaaaagttgtctttttccaggtatgaggaataatgtttacggataatatattattagatatggaattaatggttaatgatactccatctatagctattgatcctttccttatcatgtattttaatagcgcatctggtatgtgaaattctatgttgtgagaactgtttacgttagtaattgagataatatttcctactccatcaacatgtccttgtacaaaatgtccatctaagcggtcagtcatttttaagggtaattctagattaatctttgttccttctttccaatgtgcagcactagtaacagatagagttgcatcggaaacatcagcagaaaaacactcattgtctaattctactgcacttaagcaaatgccagaacatcctatggaatcacctattttcgtctcacttaaaaaattagcattggtgggttttattacaagtcttctatcctggccttttgtgtaatctacttggataatagtaccgatatcttctattatgcctttaaacatccaatattgtatcatgaattgtggattcggaattctagtatgatgaatgaagaaatgtcaataggaaaaaaatgtgtaaggtaagtctgctagcaaatatctaaaaaattaatttattgcataataattataatttttattaaaaagtatatttttattattaatatatgttaaattttgtaatactttatatgaaagaaaggacttatttgtatgttaaataattttaatgcttcaatattacacgttggacgtaatgtgagtaatcatagtgtattcgatggaatttttgaccattctgatgattttactggtaatgatacactgattcctaaaggttttaacaacatagggacaggtagggatgatttgctagctgctggtgtcattgcgttttatgtattggttgtagttgtagtgggaggacttatttattggattggaaatcgtgatcttatgcgtcaaaatggttatacaaaatgtacttctaaggcttctattatgttagaaaacacagactcttctgatagtcatgtggaagaaaaaatttctttgctaattgtttcagacgatattaatccgcaagaatcaaaggaagaaagtgaatgtattccaaaagtattggatcaacagcatgttgcttcaattcaatcaaaagaatgttcattacattattctcatgttgtgtaagtgcaatagttgatatgtataattatgtatttttgtttgtattaagaattttgttgcctaaatgaatctgacagatgtgcaaacatatatgtatagcagaaagtgggatagggagtagtagctttttttgctaaagctttgcaaacatgtaaagttagtatatgctttaatccctttcccggaatataatgtatataccccataataactgtaaaactgatgattcttaggtaaagaggtttgcttatgtaaaaatgttattttttgttattgtgtttgtatatgtaggatagcaattttctaaaatacaataaattgaaatatgattcatttttgctgtttggtaggttaccttgttatgaatattgatttagacgagaattattatataattgataacatatcttgatttttttctactcatgtcatggcttgatttgttaaagtctgtacttacttctattgttgctggggtgagtgattatacatcttttatattgaacaatactgtaaatggtacactagatgttacacgtcgtaatgttacagcactgcatgatatacttaacaacacactgactactatttctaataatgtggtttctaatattagtagtactactgatagtataggaatagttactagtaggattggtaattatacatcgtttatattaaacagtactgtagatagtatactagatgttacacgtcgtaatgttacaatgctatatgatatctttaacggcacttttactactagtaatacagtttctaacattagtagcactactgatagtgtgggaatggctaccaataacagcatagttagtcaggataatgcagcttctaattatcatataaatactattatgtatgttgttatggcttgtgctattttatgtatgatgcgtcatatttgtcaccattttatgcaaggagtgcaaggggaaagacgtgttaggcgtattgcacgtgagtttagtgagataagagaacctcggatgtcttctgatgttaatattacaggtatgtcaagagcatctatttgttgtgattctagggaagatgttgaagtacaacagagtagagttaatatagaaggggaggggggtgttgctactcagcttgatcttgagtacgtaccacagaatgtatgccataggttgagacattggatggctcgattgtgtcatagaagaagtactgtatatagtgttggtagtgatttagggatggaattagatgttatgtctagagttgaagaagaaacagaatgtgttgaagaaagtatgtctttttagatattttgtgatttgctattatatttagcagttattctcaagagatagggaagttacatttcatccgattactaaattcacatgcaatacgtctttcctcttacactccttgtataaaatggtaacaaatatgacatatcatacataagataacacaagccacaacaacatacatatatttgtagtttatataaagtggagtttaaattttcataaagattgtgatatcaacttagtatgttatctattttttatttatgttgcttttcaatagattaggatgtgctttgactgctattgtggttagtgttagtcatggtgtatcgcgtatcatagatactactttcataaagattgtgatatcaacttagtatgttatccatttttttatttatgttacttttcaatagattaggatatgctttgactgctattgttgttagtgttagctatggtatatcgcgtaccgtaaatactactttcataaagattgtgatatcaacttagtatgttatccattttttatttatgttacttttcaataggttaggatgtgctttggctgctattgttgttagtgttagctatggtatatcgcgtaccgtaaatactactttcataaagattgtgatataattaacttagtgtgttatccatttttatttatgttacttttcaatagggtaagatgtgctttggctgctattattgttagtgttagccatggtatgttgcatgtcataaatactactgcaagtatgggaggtgaaaatgttacgacaactatgcgtaatatatttactcgtgtttttaacaatactgttgatagtacagtagaaaatgagagtacaacaattccttctgcattaaatgatacagttactgatattgtgaatagtgctgttaacagtacaatggaaaatgggagtggttctgcaacaatttcttctatcttaaataatacggttgctgatgttgtgaatagtactgttagcagtacaatggaaagtgggagtagttctgcaacaatttcttctatcttaaataatacggttactgatattgtgaatagtactgttagcagtgcaatggagagtggtaatggttctacaacaatttcttctacattcaatcgtacgattactgttatctctagtagtactacaggtcagtctagtggaggagagtatgcacttttacaagcatttataatggtgatgggtgtatttctgttaatgttgtcgttgttgatgtgtgtacgtagtgttcaaagatgtagaactgatattctaagagctagagcgcgactcaactatttacgagaacatggaggcgaccctcctgatactgtaaataatgctgcaatggaattagatatagtacgagacgttgaagtggtaactgacgagttaaaccttgaaaatagaccttgtctgtgtcagcatgatcatcaagaagctcctgatgatcctgttgagcaagttagacctgtgtttaggttacagggaatattccctagatgatttgactaggaagatgcaatacgtgatactcaacttatgaatgagaaagtatcaaataagttttttgtttattgacgtaatgatcaagggggggggggggataatatttactggttaaattaaattgattttgagattgctggatgcttttggaaattatatagacaatacgtaatatccaatagtatgtgtaatttatgtaaagtgtgatctaaattttcataaaaattgtgatataattaacctagtgtgttatccattttttatttatgttgcttttcaattggttaggggatgtgttaatttctcttgtgtctagtgttaatcatggtatatcgtatgtcttaaatagtactacaagtataggaaatggaaatcttacaacaactacattaagcaatctgtttactcgtgttttggacgatactgttagtagtacagtagaaaatgggagtaatactacaacagtttcttctgcattaaatgatacagttagtgatattgtgaatagtgctgttagcagtacaatggaaaatgggagtagttctacaacaatttcttctatcttgaataatacggttagtgatattgtgaatagtactgttagcagtacaatggaaaatgggagtagttctacaacaatttcttctatcttaaataatacggttagtgatattgtgaatagtgctgttagcagtacaatggaaaatgggggtggttctacaacaatttcttctgtattaaatagtacatttactaatattttgaatagtgctgttggtagtacagtagaaggtagtgttggtaatgctacaacaatttttcctgtattaaataatacggttactagtagtactaggaataatagtctccatgatagtacacttattgcagcatttataatgataatgggtacatttctgttaatgttttcagtgatgatatgtgtacgtagtgttcaaacctgtagaagcaatattcgaagacatagagtacagatggcatatttacgagagcatgggggggggggacctcctgataatttgagtgatgctgtgatagcattagatgtgataggagaagttagtgttgtgactgaaagttcaaacgttgaaaatagaccttttctgctgtgtcagcatgatcatcaagaagatcctgctgattctgctgagcaagttagacctgtgtttaggttacagggaatattccctaggtaatttgaatagaatagatgtaatacataatactcaacttatgaatgaaagccagaatattatttggcttggtacttcttatatattgttatgtatataatttatgaagtcttttataagtttatcaagtaattaatatataaatttgttttgtatttaaagggtattaaccctgtatgttgtttatacctatacactatcaaatgtaatacagtgccattataaaaaatagtgctttcattgagcattgttcaataattatgtcaatgatactgctttgtgtcatacttgtatactttaatcatctagtgtaaaatgtatggacatagaggtgtcacaatgtaataataatacaggtgaattgccgcttcttcttggtaacttacatgtcaagcaataggtagacataatagttgggaggtatctcatagatgtggttaatggtatatttattaaaagctactctacataacaaattttaaaaggttattatactttatttgattttagtagtttttgatgataatgatgcaagttatgattgtgtaaataataagaatattaactcctgttagaaaatattggctgtatctcttgatatgactgtaaatataagtgctactcttgattgtatctgctaattagaagttatagtgtaaatatctctctttgaggaggattatttgtagatattatttatgattgttgttttgcattaaaggagcaatgcttagagaaattaaataatattaataatagtgtgtgtttatatgaatgataaagtatttgttgttaccataattagtatgatagtattggtaactttagtattcttttttttcccattattttcaatatgtcatcgtgctgtaaaggataatacgaatcaacaggataataatgtgaattcagaattagatgatctagaaaatgttagtgatgatgttgtattagtagcccagcagcagaagctgaggttttgatgttgtgggtttgctctaatatttttcagcagtatatctaccaaaatatgtgtgttttaacattggtacacttgaaaaagatgatgttattgtgaaattttatctcaaattaaaaatataaaatattttattgattaatgtatgtatgcatttcattacattatgaatattactgtaaaattgtcttttttataagatgaggtaatgagtagatattgtatagtctatctatattttatcgatgtataatagtgattactctcataataatgcaaagtgtgtgttattagcgtttagaattttgatatcaagaaattaatatcagaaataaagattaatactattcatatatagcttctaactaactttcctgatatttttaataataaatttataatattgctttcttgtttaataggtttattttgctaatgtggtgtataataaaacttataatgcaattggaactgttgttaattagcataagtatactattgttttgtatcttaaaagttagagggttattgataaaataattaagaattttttgtttaagagttgtattgctatctatttttaaaaggatgctgttttttatttgttcgacttcataaatgccaatatttgcacacagttgttttatatatatggtgttcaataagttttctacttcgtttggcaatttaccaaacttattggttaactctatatagtaattatctatgtcttcttttgttttaagactgccaatttttttgtatactcgcattcttaatcctatatcttgaatgtaatgctcaggaattcttatattaacattgatattgatatttatatggtcaagatctttaggatattcactataaatgttaagttcttcttctaacatttgttggtatagttcaatgcctatatcttttatgttacctgattgttcttctcccactaaattaccaaatcctctgatatccatgtcatgtaatgataaattaaatcctgaatttatagaatctattgattgtattatctccagttttatagcagatttattggttgctttttcagataatataaaatatgcaaaacccttggtactgctacgtcctactcttccttttaattggtagagttgagctaatccaaacatatcggcattgtgtattatgattgtattggcaaaagggatatctaatccacattctataattgatgtagtaagtaatattgtgaatttgccatcaaaaaaatcgttcattattgtgtcaagttgggtaggggaaagttgtccatgggcagtgttcatttttatttctggtactaattttcttatcttgtcgctgatgctttttatattactaatttgtggacaaacataaaatactctaccgcctctattatgctctcgtattatagcatcttttattatagtttcttcataatatgttgtataagttgtaactgctaatctattttttggtggtgtttttattaaactcaaatcttttattccacatagtgacatgtacagtgtccgtggtattggagttgcagatagtgaaattacatgaacgtttgttttgattttttttagtaattctttttgctttactccaaattgttgttcttcatctataattaataggcttaagttagcaaacgtaacgtcctgtgctaatatggcatgtgttcctattattatatgtacttgtccacatgataaactttctttagttttttttatttcggatctcgcaacaattttagataattgtttgatttttatattaggaaattttttgaatctttcagtaaaaacaataaaatgttgcctgcacagtagagttgttggtactataattgctacttggtagttttgacttgctactaagaatgctgctcgtaaagctatttccgtttttccaaagccaacgtctccgcaaattaatctattcattattttaccacttgatagatcatgttccatgtcttttatggcttgtaattgatcttctgtttcagtataagaaaattcattacagaagtgtttataattttcatcagggaaaaatgatttgccagtagagagtcttcttgctgcttctatagttaataattcttttgcaatttttttgatatggttttttattttagttttacgttgttgccatgatgtactgcctagtttatcaagggtaacattgacattttgttgtccatacttggatataagattaatattttctacaggtaagaatagtttgtcgttgttatagtactctattttgatgaaatcatgataactatcaaatactttagtagtttcaagtgctactattttcccaataccatagtctttgtgtattactatatctccaatatctaggttagtatcattgctaataatatttgaaatgttacttttattagttgtttcttgtttatataatagatcgtgttctgctatgacaatagtatattttgagataaagctgtgatatattggtaatatagcaatattatatgaagagcatatttcctgatagttttctattttgcatagtttgatatttaatgttctaagtctattttggatatattctaaagagccagtagagtaacaagctattattaatttttttgtgtgacatgtagttttgatatattgtgtcaatatttcaaatatgtcgatttgtttgttttgtactaatgttttaaaatttgggacgttttgtatcttttctgtaatgttgaaggaagaagtatgtatatttctatcggtataggctgaattattactagtgttgtcagattgtgagaatatagttttatgaaactgtttagttataattttaaattcttcagaatcaacgtaaagttgaggtggaggcacttggtaggatagttgagatctgtaatttaggtatatctgattattatattcttttatttcatttataagcttatcgttaaatattaatgttgtgttttgtgatatgtagttaaaaatattttgtaattcttctttataaaataaaggcaagaaattttcttctcctatgtgtttctttccagagattattgtgtttaataggttttgatcttggtttggttttgttttataggttttagaaaaaatatctatattttttttttgttttattatttcagaagtgggataaataacaacctcatttaaagaagagttattatctattaattgtgtttggcgattgaaatagtgaattgattgtataagattattatttaaatgaatccttatgggatttttataagttgtaggaaaaatgtcaatgatgttgttgtaagtggcaaattcacctatatcttgtactattgagtattgactgtatccgtgattggttaagtaatcttctatatggttttttgtaatattctgtagagatgtaatttttaatactgattgtaatatgatattttggtgtaatactttttgagtaattgcattaattgttgaaataataatatagggattatcattatgtctagtgattagggaatatagagttttaattctttctgccataactgaattatgtggagaattttttttatatggtattgaattccatgcaggaaatatgattatttcaagatttggaacataaaacttaaatattgatgctagattatgtagttgtgtttcttgattgactatatatattgcagaatgaattagtttttttatatacatttttattatgacaagtggttctagcgtttgtggaatattgaagattttattaatattattcatatgatagtttaatgattttaatagttgatattgtaagcagaaaatatagtctataaaaatgtattaagaagtctatatttcaaagacatgtatagttgatataataagacttatatttgtgaattgcatttgtagtatacatcaaattttattgtgtggaattgttctttcattgtaatttctaagtttatggttaaataaaagcttgaatgttgattaacattataacagtataacataaaagttttatattgatttaagttataagtaagtatcttttgtttagtaaaaataccttatattgaacatatattcaaaagtaattcacttgtaaatcccagtttacaactttccactaataaagacctatacttttttcattgaattaataaatgtataagtgtttgaactacgtttgaaaatccaataataaggtatttttctaatctttaaggacgatataccatatcctgtgatcctgattgcaagtctatatgtgtaacactactattaggattatcacatatatcaactataaaaaaacctgatgcttctaggacatcttcctctgagatgaattctatgtctgaattagtgtcgttacttaccgtatctgaatcatgttgttcatgactatctattggcatgttttctgtatcactaataccatctgagtcagtactggattcccaaactggaatctcgtcttcattattccgtcttggagtttcttctatatcactgagactgtctaagttagcactagattgcaaaactggaatctcgctttggctggtatgctgctccatgttattatggtctgaactttgtgtgttctcattagaatgcgtcgtagagctgttttcattgtgttgggggttattgttcgttgcattggttggtattattggtggtactattcctgatattagtattctaggtaatacatttgctaacatgtttccccagtttcctagcgtggtaaatattgaacgcaatatgttccatataggattggaattgcgtgagttattattatttgataaatctttcactttatccctcaattttttaactatatatatactgtcaagtataatgtttgtgattatattgtgttaatatattgttgacaagtgtaagatttgtacaagaaattcttatattttaagaatttttgctgttggtaattttcacaaattgtagtcatgagctatataatggatacagaaaaaagtatgtatgttaattgatttgatgttaactgtaataagaagaattttgaattgcttagaatgaactctggatgaagtttagagttttgttattgttctgaaattaatttataaagtatattggctgagttgctaatactagtaatagtttacctattgtaatggtgaagtattcattattttagtgagtgttggttaatttgattttactattgtgcaggaacttgctcgtgtatgttatggtgtataatcgatatctgttgtgctgatattaggtgaagtgataatatattctccatgtgtgcaaatacttgaagttttttccattagtttttattggttagctaactgttctctagttccaagttatttggtggtaataagtaaatgacatgttttaaaaggcaagtgagtattgtagtgtgcaacatggtctgaaagtacgcataagccttattcatctgttacaatgatggatgattaagtattgtgtggttaaagaaataatgatcaagagaaggatatctgctttattatttttagcactgcttttatttagatacgcataagccctgttcagttgctgcagcgaatggcaaatattggctaggtcaagaaaataataatcaagagggaacatcaactttgctgttttttagtactgcttttatttaaatacgcataagacctattcagctgttacagcgagtgatgtaaatattgctaagtcaagaaataatcaagaaaagagcattaactttgttgttttgtaatactgcttttatttatgacattgtgcacacaacctaaaaaacttattaaggttttaagtaatgctacgtcctcttactgttattggaatttgtaaaccttgtactctaaatatattttttattgataatgtataaaatacgtaattttaaaatgacataatgaccgttagtgtaatgcttactgttgtgatgttaatgcattttaagtacatataaaatttgtcttttatgtatttaattgatagtcttatagttatgcatgaggtgtaggtattgatttaaattaaacttgtataaaaatggctttataaaaggagaggttgagtaaaattagctaataataaaacttttttcataatctttcagtttatatgttgaagtttgttattagtaaaaattacgttttgcaaactatgtatcataacacaataaattacaaagttatcaacaaaccttcgcgcagtattatggataaattattctccgactatgtgcgatttcagctgcgttaagtataagtgattctactggtccatgttgtgttattaatgtagatagtggctctggttgttctgtcgggtgtggtgatgttgttgcttcttgtgatcctgaagagtgtccttctgaaggcgtagcatatgtatcgctactgctacattcttctccgtgacttgtagaatcacaagtttcttcttgtggaacaggaatatattgttgttgttgtctgctattatacgcatcagcaatgcaactacaacatttagcaaaaaggaatgccacaatgttaatcaatattgtagcaagacggtataccattgtacatgctaaaattcctatgaatattggtgatagcataattataacaaaacatagagctgcagctgatagctttttgctgacatactgtagatgattcctagcagaatctgaaagtctgcgaaacggatttcttacgctaggtgaagggaagattacatcagagtctccataaacagatatatcatcatattctggctcttctggtaaaggttcctgattagtactgcgtgcataattacaagatagagcccaaggaagaataaatgtctcattgaatatcatcataaactgacgtagcatcattactactataccgacaactatgactggtacaaatagtataagatagagatctgtgactaacatcaagcattggttaagtatagctcttttcaagttttttgcatgtctactaaatactgttgatggtcggcctcccggaaccggactaccgccttgttgttgttctgcttcttgttgttgtagtattacttcttgtcgttctgcttgttgtcgtagcatttcttcttgttgtagtgcttgttgtagtagtgctgcttgttgttgagctgctgcttgttgttgagctgcttcttgttgttgaacttcttgttgttgaacttcttgttgttgaacttcttgttgttggtctgcttgttgttggtctgcttgttgttgaacttcttgttgttgatctgcttcttgttgtacaacaatacgtggatctgttatgcttctcactgttattctccatgaaaaagatagatagaaattatttaattataaaccgtttactgattaaaaaacaagtaaaaattgttagagttgtatttcgtatatattatatggttatgattatctagttgatttgattgagcttatgtttgtgtaataattgtggtgacttgatctgtaattataagcttatgtaaagcttatatcgtaagaaaaagagttggttttgaaaaaaattttttattgtacttcaaattattattaatagataggtgtgttttgtaaatcatatagtgtatttatgtaataaatacattgtaagttgatacctaagtataaatatgctgatgtgaattacatgttgtttgtgagcaaaaaatatcgttattatcatactctaaaagagctttttcatgttattgtaaaacataatagctaccatacttagattgagtactacttgatactgctctttttctaatatagtaagagtttatttcttgctaggtttgaaaaatgtgtaatataagttatattcattttgaataatatgatagctgtacattagtttcgttatttatgtatagagccgctctcttgtgtatttgtagtgcaaacgtctgttaagattacagatgggtttacattattatcctcttcattcatcagtctaagacttccatgcaacaacagtggtatttcatcatcatcatcaaggccattattactttcagtatcattagtatctgtgttgcgtccgtgtgtgtttgtaacgtgaacctctgttaagttgataagtgagattatgttttcttcctcttcgtcatctattagtgtaagatgtgcattctccaacagtggtatgttctcttcactgtcaaggtcggtatcactatcactatatccagtttcagtttcagtttcactatcaagaagtaaattattataaggatcagtgcgcgttggaaaaaacaactttactacagcaatcataaaaacaactataagaataatactatagaatatcgtcgttgccatgtcttcagcagtatcgctggaaggagtggtaatattcgataatgttccctgtgttgttgtcagtgctccagtaggatttgttgttaagtttgtttcatttgtcataatcttttacttaattgaatgaattaagaggtctatttactagaattatttatgctagtgacttatggataacttgattaatacaaatgtattccatttttagataagcacacctgcaaatgataacttaatactgttagttagtcaatttttttatgattttagttcatatgagctgataatataacaagggcaataactttctattgcatttggttgtttatggtagaaaaagatagcgtatatctatattactcaagttttttgcaataaaagctggatcaatgaaggcttaaataaaaaagtgatagttagtagcattatattctaaaaagactacataatcatatgttatagaacattgggttaatttgttttcttcatctggttaaaaactgtgtgatattattaaaaattactaagctggataaaagtaacggatataaaaattttaacctataatacgacgcaattgtatttaattgtttagttattataatttagtgacttgattgtctccatgagattgtactgcattgctagctaataaagatagatttgtgctaacttcttcattttcttcatctgaagtagaatgagcatcattttcgttatgaaattgtactgaattgctggttaataaagatagatttatactagcttcttcattttcttcatctgaagtaggatgagcatcattttcgttatgaaattgtactgaattgctggttaataaagatagatttatactagcttcttcattttcttcatctgaagtagaatgagcatcattttcattatgaaattgtactgaattgttggctaataaagatagatttatactagcttcttcatcatcttcacctgaagtagaatgagcatcattttcattgttttcactatcaaggttagatgaatgtgatgtactattatttgatgctaacgctgaagaattacaagatacatacccttcatcaattgatggattttgccttatttgttgttggttattattaaatagggcactcaataggacatagagtacaaagactattgaaacaaaacataggaatgacattaatccagtcttaaagtagtcagagggttctttgaataggtaggatgtgttgcttgtagtgttaagtgtaagggtactgtttgttgaatttgttgtaggatatgtagtgttagaagtgagtggtgtagtagaatttgttgtggatgctgttgtggtttctatagtagtgttgataatactatttgatattgtatttaatgtgtaattcacaccttctcttatgttgttagtagtattagttattgtagaagttatggtagaagcgatattacttgttgtatctgctatagcttgcgctgtctcactaatagcacttgttgtgttgttcattatagattgagtactacttgatactgcatttattgtagaactaagaagtgtactgtttgtagatgatgtggttactgtagcactacttgttgtactgttcataggatttgtggttattgagggaggggtagtagtattgaccataaaatatatataaataaatctaatgacttaattaataagagtgaaacattgtccagtttaggataaaaacacctattaataaataagttgatattacttaattagtcaattttttattatttcagtgagtatgagttaactatagtaagatttaatggaaaattatttgtcatatatagcttttgataagagaaattaaattggtagaagctgttagttatttacaacattgaagtgttgaaaaaaaaaagataatttattgtgttttagtagataggtttatatgtatctgttgactcaaatttttcgtggtaaacagctaaataataatagggatatattagaactatatatgttctacatcctgagggagcactaggtagtttacttcctcctgaactgttgtagaaatatatgttaattattgggatttacttgccctattatcgtgataccgttgtgtgttgaccgcctgtaatactgtgcttatttcttcgtgctcatcttcgtctgatgaagcgaaaatatcactctcattgttttggtcagttgtgtgagaatgtggtgtacgtaaaattggaccttctggttgtgaagaggggggggggggtgagttcgttgtttgtatcatcatagtcatggagttgcagttcgaactgcgatagtgattcttctaatgtcccatcgctgctgtgccgcagccttctgtgtcgacgatgtgcattaggtaaataacaacagtgatatatcatcactattattgctgctaacaacattattatagaacaagtaataagaaatgtttgatcttgttctggttgatttgttgtcgtattagcagcatttgttgtagtattaaatatagattcagtaatattgcttgatgtagaattatttgtagtgaaagtgcctgctgtagtggaagatgttggactgcttgtagattgtgtgacactactagtaaaattttgaaatgctgtacttgcagcttctgatgtagcattgacaatatcagtaactgtagaagagatagcagagcttaggttttctgctgtggattgaacgctgcttacaattgtgcttaatggggaagtattagtaggagtgccttgtgtagttgtcgtggcatttgttgtattattcaccatagttttcttacctgaataatgattatatactttaattgataaaagagagatgtactttctagatttatgtaagtacacctgttgattgtaggttagtactgtttgttagtcaatttttttatttcagttcatatgagttggtgatataacaagatttgtgttgaatcctgatttgcgtgtgtaattctataattatagaaaagttattaaagtaattcttttaatagaagcttcaaaagatgattttacttaaaagcatgtaatgctttataaaatgtaattcttactttgtattgctgaaactggaatatatgctaactaataggagtaggagaatatttttagaaagaatctgcatttgtagtggtcatatagtacaatggatctctattcttattctatggaaggagtacaagtgaattttttcatgctgtcatactattagttagtgtttttataattatgttatcagatttattattgatatataaaatttttagtactctaaaaaatagaattgatgtgtaatatacacatcaaatcaacaaaaggatctttatagaagataatgagaataagtgtaacattagagataatctgattaaacctatagtatgatagtataaaaaattcgcttatactccttccatagaatagatatttattgtatgaatgtatgtataatgttactgtataaaactataaattgtctttactaccttaactatatagaaactaagtaatatgtatcatacagtatttactatgttgtttatataactagcatttacaatgatctataagcttgtcgttaatcatacttgtgatgtcatttttcatcgaagcattataagaacagaatgaataaaattatctaccttatcttcctgaagcgttagtagaattactattattatgtcttctagtgttattgtgtggtgcatctacatctactaatgccataacttctctgtcagttagctcaggttcataaaatgagtcatatagtacatagttagtaaagttagtatgtcttctaatctcaaaactagtactacgagatggtgcagtagtacttacttgattttctctgttcctgtgcatacggcgacatataataatcatcagtataaataaacacgttattgctataatgggtgcatagattgtaactgagttatcactattagtactattgttactttgtgtagaattagttatgttcgtattattcataattatattaaaaaacttaattttatatttttatttatataggttaataaattaaattcaatatttaaatataaaaaaatccttctgtagtgaactttttttaattatgggtatattttgttttgttggtactttaggaaatgagttaacgactaagtatatgattaatgttgtgatattacaatgcaatagtatgtaatgcacatcacgagtattttgtgtaaatagttaaaaaaggttccttttatctgcaaaaagcctacagcatgcttgacgagcttaactttatgctatgatctacaccgtaaacaaagtcattaataagtctgttaattgagagccaggtgttccgtttgaaagaatacttcttgtaaatagctataaagaaaaaagattctttttatctgtgaaaagcctacaacatgcttgacgagcttaactttatactatgatctacaccgtaaacaaagtcatcaataagtctgttaattgagagctaggtgggtcgtttgaaaagaatatttcgtgtaaatagttatagagaaaaaaaggttctttttatctgcgaaaaaatctaccacatgcttgacgagcgtgagctataccataatctacactctgaacaaagtcatctagtaggtctgttaatcgagagctaggtccgtttgaaaaattgtacacaggtgtaaccgagtcgtttgtttctataacacgtggtgagcgaccgtgcctaacatctgtattctcatcgcatcttacagatactggtagcacactaccatcgtcaaacctaataacatcaccatgttttttgtatcccttttttttgtcggaattttcttctgttaatggtatctcttcgtcttgatgacgttgattggctcttgtatgttttgagtgaatacagataataaatgctaataataataaggaaaaaaagaatatgcctatgagcgctaaggtggtctcctgtttgttatcattggatgttgtattagtaatactagtagtatttgtgatattccctgttggtgaggttattccagagaatattgtattatgaatattgtttgcggtacttgttgctgattctataaaagaactgatactttctgtggaagttgttattatactatttgttatgttagtaacgttattaaaagcattgctggctgtagtttctattgctgaggttactgcagaggttgttgtattataaatatttgatgcggtatttgttgttgattctagaatagaactggtactttctgcagtagctgttattgtaccgtttgttgtgttactagtagtatttaaaatactactagctacagtccctagtgttgttggcatttttttacctatgaattgaaagaattacacagtatgtaaagttaactttggtctgctagatagataataatgtaatagtatgtaatcgcaaactccttcttgatttgttagattatttttactacatacccctaaaataatatgatttcattgaattgaaagctagttagttacttaatttaacctcatgcataacattatgtactaggaaaatgccaaatgttttaactacctataaaaacaccagtagcatttgttatagatatacactgaattttattaaaggaaactataacaaacactacttagtatttagctgtataagctaattgctatttataatacttaaagtatgcttacttgggctaaatttaattaaccctacacctcttattaattatacattagtatttttttaaagtaaaactttttctcgtaaaaattgattttttgatagtaatactcgttttgttagatattcatagtcaatgataacattattgattttgaggataatgcttagttttagtacatgtaagtaatgcttactatttatgtcgtaagcgtacattttttgttactaaagtttaatggtatgaaaaagtgttttttgacaaagagcttaatttgtgttgaattaagtgaagttttttatgctgagtaagatgaatcattgttgattttgcggttattttttatttcgacatgaaattcaacatgagcttatagcattttttcattagatttagtattgagatataaaaatgtgattacaaaatttatatattcttagattgttatattatttaacatgttgttattgaatacgtagtgtaattatgttttaaaaatattttttaaagaacagttaattcataattatattatgttgcctaattaaagaaattttctgataaaattttaataaggaagagtatatttgttattgtatgaatagatgcttgttttcagtgttgatatagtcaatattagatgttatccttaagatcaggattgttttgtatatatttaacatgaaagatgaactgaataaagtagttatttatactgatggagcatgttctggtaaccctggtcctggaggatgggcagcagttttgctgtttgatgataatgaaaagacaatctgtggtaatgattccgatactacaaataataggatggagttaacagcggttattgaggcactgaagttattaaaagtagcatataatgttgatttgtatactgatagcgtatatgttaaagatggtattacattgtggatcaggaaatggaaggttaatggatggaagactgctaataagatgccagtgaaaaacttggaactgtggttagaattagatagtctcgctaattttcataaagttacttggtattgggttagagctcatgtaggggatttgtataatcagaaagcagatatgcttgcacgtagtcagattgtcaggtgaattttatcatgtccttatgtttacatttctagaacattagatcagtgtagtaaagtaaatatatcttttgagtaatatgtatagataacaccgctgtgtattaatttagtgtttattatgctaaaaaaaaaaaagtttataagattattttttatactgatgatctctattgtgtgtagtgtatcctacctgtatgttcgtgatagagatgttatagagattaatgcaaaatttttgaatttttatgtaaaacataaacttgctacggtttttcctggttctgagatagatataggtagtactacgttaacttggcaaaataagagtgaaaattttatattatcatcacaaaatcttactattaaaagccctaagcttggggcaaatattacaatacctaagttcctgttatattctagagttgggatattatttttgtggggaaattgtgatttttcttatattgatattcctaaaatccgtattgagttctatgacattcaaaaaaaagttggaataaatcttgtagagaattctgtaaaaattcttaaagatatgctgttaaaggcaatcaaactcgatataccagtatttattagtaatgctattcttgctaaacatggtaaggaagatctaatgataaaacaacttagtgtcaaaatgaataaagggtatgataaaaatactattgattttaatgtcgaaaatgacaattctttcatcagtatgacagtgcatgaacactacaaaggtataatgtcttttgagatatcatatggtaattttaatactaaggtattaggatatttaggtaatttaaatgcaaagcttccgctgtatgataatttaaattttagtggtgatattgtattgagaattgatgaacatgatgaaattacatatggtgatgtaaatattcaaagaataaaaggtgttgttccttgtgtttcttctcgtaaatgctacatccatgattttaggactagattagtatatcaaaatgatattctatcagtgaaaaatttttttttattgttagatcaaagtaaaatagttgctactggaatgattgataacgaaaatgtggacttgacttttaattttgatgttatatttccaaagacgctgtgtgattactggtttgttaatttatatcctgatttaaatcgttggtattgtactaatgtgacagacggaaaaattactgatctgaaacttcaaattaaaggaaaacgcgatggtatgttcatctataatgatctttcaaactataatgttagtgcaaatatagaaaatgtttcgataaaattcaaccataattttgatccagtgcgtatagtgcatggtaaattatatttacgtgataatcaatttattattacttctgataattcggattttaaaggtgtagttattcaagatggaatattaaaaatagataatttaaaagatgaaaatgcagtgatgaccattagtggtagttctgtgggtgacgtaaagcaattatataaagctgtaaataaagatgaatttatactgttagataataacaaaatttttggtaagtctcatactaactttgattttaagatatttaatttactaaatgacgatattgtagattatgtatcttatatacatgcacaaattgaatcttttaaagctggtagtattttgaatacttttgatgtttatgatgctaaggttgatgttacattacatgataacgatgtgaatataaatactcagggttatatgaatggctttcctatgtctttgaaagtggatagaaatttgcaagataattataaatttcactatgaatttgcagggtatatttcagcggacaatataaaggagttaggaatttttgaatatggagattgttcaggagtaatgaagtcaaaccttcaatgggatattaatgccaataatacagtcattacaggggatgttgatctttctcagttaaaaattcactttgatggattaacacataataattttgatagtgtagtaaagttttctgcttcatttcaggataagaaagaaattaaaatagatagtgcatctatagttggtaaaggtgtagatatagaactcagtggtaaaacgggagccaatttagaattattattaaataaggtaaaattgaaagatacagatattacagctgagttaaagcggagtaatgattctattacagtaaaagtattcggggaatctttagatttaagtactgttgatttttctgagatgatgaaaggggaatctccgatgcaacaaactaaaattgatgtcaatgtaagtcgcgttatgatgaaaaataatgttgtagctaataatgtagatttcaaattaagttgttatgatactgtttgtaatgaaataaaattgacaggaaattttctagataatagtaattttagtttagagtatgggcctattggattagaaataaatactgataatgcaggggaacttcttcgtgcgatagatattttaaaagttgtagataaaggaaaattatctttctatatgtatccggtaaaagctggtgaaataacttctggtatgttttcattaacaaattttcatcttgtaaatgcttccattttggctcaaatattaacattatcctcactaaaaggagtagttaatacattaaatggtaaaggaatatatttcaatgcattgaatgcaccatttacttatcaagataacttaataagtatagatgagtcttggatagagggttctgagttaggtattagtttaggtggggaaattgatctaaatacaaagatgtttaacataaaaggacaaataattcctgcatatgtgattaataaaattatatggcaaactccaattattggaaagttgttaaccggaggacaaagtcgtggtgttatcgctatagattacaaggtaaaaggtacagataaagatcatgatttatcagtcaatttgatgtctattttgacacctaacttattaaaaagggtattaaaaatatttgatagtaaattgttaaaaaaagagcatgtcaagaaaagatcatctgttaataaggtaaataatcaggtgagaatggtatcataaaaaattttttcttgtttaggttaattttaatattagtagcacttatatagatttcggtataatttcatatataagatcatagttaatatgtgttgtatataaacgacgtgtcatgttattaggaaaagttcatgtgattgaaagtttactattaaataatcagcggaatgatgtctaaactacatgcgggaacggattttagtatattaaatgatgtaaaatacatattactgaattcatgtagttaagtaattgattgtaggaaaatattattatggtgaacttatagatatgaaaagaatttgaaaaattgatttttctgtttgtatatatgtgaaatgattttttgcgatatttaaattgattgataaagataaattaaatgctgataagaaaaataagaatagcaattatgtgcctactattgatcataataaatttatgatattgggaatttgtatattgcatctttttgtagctaagatataatttatcgtatctgtgtttgctatattttagttactagctaagaaaaggaaagttaatgagtgaggcctctgctactaaagttaagtattctagagttttactaaaagtgtctggtgaagcgttaatgggaaaaaaaggctttgggtgtgatatagaggtgctggataagctatctcatgatctcaaagaagtccatagttttggagtacagctgtgtttggttgtaggtggtggaaatatattccgtggtgcatcagcctcagcatcttttggatttgagcgagctagtaatgactatataggaatgctagctactatgatgaatgctttatctctacagaatgctttggaaaaagtaaatgttcaatctagagttttgtcagctattcctattactgctgtctgtgaaacatacattagaagacgtgctatacgtcatttagaaaaagggagagtagttatatgtgctgccggagtaggtagcccattctttactacagatactgcagctgcgttacgtggtatagaaatgggttgtgatgctatatttaaaggtacacaggttgatggggtatattctgctgaccctaaaaaaaatgctgatgcggtaagatatgataaaatttcttatcgtgatttattatcgttagatcttaaaattatggatgttgctgctgtttctttggctagagagcattcagtacctattattgtatttaatctgggtcaacctggtagttttgcggatataatccgtggagatggtttgtatacgacaatatataattaagttaaagtattggtataagtgaatgataagtgaagttaaacaagatgctaaaagtagaatggaaaagagtttatctgtatatttaagtgatattgatggtattagaactggaagagcaagaacttctgtattgaatggaattgttgttgaaacttatggtggacgtgtaaaattgaatacaatatcaagtgtatctgtatctgataataaaaccttgatgattaaagtatgggattctaacaacataggggctatcaaaactgcaattatgaattcgaatcttggatttgggatttcttgtgaagcaacaacaattcgattgactgttccagatatgacacaggatatgagaaaaaatttggttaagttattgggtaaaatttcagaagactgtagagtttctatccgtaatatacgtagagatatcatggatagattaaaggtcatgcaagatagtaaagagatttctgaagatgatttacgtgtagctggagtagaaatacaaaagatcacagatgatattatgaaaaaagtaaatgatgcttttacttcgaaggagaaggaattgttacatgtttaattctaattatggttttacagaagtcagttgctttgttttgatatttcaaagaataaatttttaaaaagttgatagatgcatgactttgagtattaggaagtactatcttaatctgaatttatatgtaatccttacttcataagtttttttttccataacccctaatatattctttatttaagaaaggtataagctgtattttaaaataattcttattataacaatagcgtattggcaatatacagttatatatgcactcctgcaaaggaatcagtgaagggagaaaaatgaagaaattctgagggttgtagtaccagacttcatgagttttttccataactccgtaatatattctttatttaagaaaggtataagctgtattttaaaataattcttattataacaatagcgtattggcaatatacagttatatgtgcactcctgagaggaatcagtgaagggagaaaaatgaagaagttctgagggtttatagtaccagatttaacatttctaattaatgtctaaataaaaacatcaattcgaactttttgtaataataattgcatactattaaacttgcaacacaaaataatatatattaagtacgctctagtatagaggataataagcataaagttttatattttttaatgcaatattcgttaatattagtctgtataaatttaatattatgtaataaagacaaataaaatgtatttagtttttctatgattttagttaacattatactaaattgtatttatgatataattggttgtttttattagagaatatcttgtataagtttaataataatttggttgaaacaatggtaagtggtaatttgtttataaggtcattgtcttctatattgatttgtgctgttgtatctttatctttgtattttggaggaatcgccttttatattttgtgtttttttcttgctatggtttcttctgttgagttgtttaatattatgcaatgtagaagattatattatattcctgcattttttatgatagtaataccttatgcatctttggtatatatttataatttattacatggagagataatcctgatatggttgatttttgttatttggggaacagatgtagctgcatattttgttggtaaaaatattggcgaaaaaaaaatagttcctatgatcagtcctaataagacatgggcagggttgtttggaggtatagttgctggagcgtttattagtgttgttatatctgtaatttttggaatattttttgtattccatgcatttatcgcaggtattcttatagcatttgttgcacaagttggtgatattacagaatcttatgtaaaacgcttatgtaaagtaaaagatagtgggagctttattcctggacatgggggtattcttgaccgcatggatagttttatttttactgcaccgttggttgcttattatgtccagaagttttctaaattttttctagcataatagctgccagttttttaattttttattacaatttttacgtttttttttgcatgtattctagttgtattagttaatactatagcatatataaatgtacccaattaatatatatttccccttttactgtttggttatttaagtgatcaaatcacaagcttaacttcatttaattaatagtagtgcaggatgttagtatgtaggttttttcctgtatacagttaattttttaaataaatttctagcatttattataattatatgtttttattagataaattacttaattttttaagtattagaaatttatttatgaggttttcatgcgtaatatatctaaccttttatatttctcttgttattcaaagttgggtgagataagtggaaggttatacagtatgcattgtgctagattagatgagaaaccagagctgtatagaccatttactttaaatgcaggagcattgttaagacttgctagttatgcttgtgatgctttaagtgaccaagctgtggtggaacgtgtaaatttagatcgagatgttgtagaaattataaaatttgatgtattgaatattataacttctttaattaaggtatataatagtgttattgatatgcgtattcatcctgaacaaacaaatgatttagtattttctgcaaaattgttattacatgaggtgaaaaacactttaaataggatgagatgtttatgccagaaattaataaagtatagtaatgtaattgcaagagatgattttttgcatatgtctcttgctgttcataatcttgattttttttcttataatatacaggagtacgttgacgatataaaatctgcaatatcagagccgtgtaggtcaatgagtatggcaagtgttcctgctacagaacgagcaaaaatatcaagtgaaaattttaatatattagaacccttagattttaataagaatcgttatttatgtgatttgaaggataaagctatatctgaattagttccagtatatgatgaatctcttactgacttgggacttagatatggatatgatatatcacttttgttcaaatctgttatgatatctactcaagagtataggcagcctttctctaaaggatcacgattagttatattaaattgtgggagagtagcatgcattaatgatctaaaagatggctttattttatataataagtttatagtttctttagctgaaggtggtgttgtttatagtacttcctctaatataggtttaagagagttgtctggttgtgatcaagaagctcaagggagggtttatagtccagattctgttttatctagtagtgatgaagaattgataacttctttgggtagtgcagataaaaataagtaatatgttgacaggtaatgaaacactttttttatgtaattattagtactaattttgtgattactaaaagattattacaacatttaagccttttgtttttatgcattttcaaaataaatattctgtaattttatatggttactgttttgtaaatatatgattagtagtattttaataaaattattaaaatataaatagtagtatataaaatatttttgtattaaaactttttctttagtaatttgtttttaattttgcatagatgaagagtttattggtgattttacatattaagtatagtgttaattttagcaaatagtaaatattttaattaaaaaaagtgggtattactaattagctgatatttaaatgtaaattatgtaaaaaagttaacctaaattatataactatatgatctaaccataatatcaatactatttttgtaaaagaatagtaataaaagatgttttttttaagctttttcttaatatcttgtaagaaaaattaaatagtactaaaatatattaatatttattattaatttttaggtgttttatggctgacaatctaagtaaaatggaaaaaaccttaaatataattctttttattatactttttcctattatgttaccagtttttttatatattaagttaagtgaaaaaattaataaagctgtgtctgtacaaaaagagagaagcaagattagtaggggagcgaatagatatgttcaaggggtgttaagtaaatatagtgaagatacgttaaaacatgatagtcgtgaaagactaaggtttcgatatgcaacttctcttattatgcgttcattatatagtattacaacagagcattatagtataggtaattatcatgattcagaacatttgagcgcattagaacaactagctacgaagatggtcataagtcgtggttctataatgagagcttatgcatttgttagtaattctatacgtagtggtcaagaagattgtgattctgctgatagtattaaagaaataaaaaagactatagcattattcgaagaattatatcaaaatagctctgatttcatgagaaaagctgatgccatttatgcggatgttaagggctctgaagtctgtgagagagtattaaaaatgcatgacgcaagtaaagtggtgaaatataatagtgagttttgtataaaaaagcttaaaattatgttaaaaaatgaaattgctgcagcaaagcggaacggtttatgtaatactagtgttgatggagtttctaatcctggtttaagtgctgcttaaaacattgttttgtataccatacatgaattgttaatggggctaaagctccattaacaggaataatatcataagaaatataatttatattgaataattttatatgattcatattcattatttgagacgaatttgatgtgtataaaagaaaatgtgcttaagaaactatgaatactcttgatgataattataaagtgaggttgaattaaattataaatgtccttatttgtagtaactatagtaatttcaagcaccttttatttatgtatttgatatatttagatattaagaataattttaagtacgttaacctgtagtaagaattacataaattgaatttttcaatattaaagcacccttatactaatatttttaacatgttctaaattaatgtaaaagattgtaaagtaagataacgtatgattgtttagtagctagattgttagttagtgtaaatttaaaaaagcatttatgttgcttaagtgttagttgaaatgggcgattgaagactaaattataaatgattatagtttgtatttataaattttatttaaatttattagattttaaattaggtagaagaatttttataaggtaaattctattaatagtttatgatattttaatagtttgaagaattacataaaagatttctaaagtgaaccgttggatttttgtagcaatgcttatgactttagtgtaaaagttgttctatattattaatttttaactttttgaaaattttagtacatacttactcagtgtaatagtatatttgttaaaaatctggaagtattaagtaattgttctattagtaagctgcatgaatttgtaaatgtatagtttatcctaaatattctcgtaaaacatgtttatatgttttatcttaaaatcatgggttttagacttgtcttagacatgttattctaaagggaaatggaatttagaacaaaagatttatgaatgtgttttcttttatttctaggtttaagcaactttttcgtattttaatgttttattattattgtatgactttatgtaatataattttgtaactttttcaatatttttgctgaagtaggtgttcatattactggtggattataatctgtgattttgtattctgctcaatggaaaataaagttgattattgtataaaaataatctgagatattgtgtgtaaaatgtaaaatttgctagatactactaaacataaacaataattcttattattaatcattattaatcagttatgaaattttatgaaaaactagttatgaatatgtgtggatagtattttctaggatgatatggagcaatgtaataacttgttatctaataatttctgcatatgtttttgtgactgatagcacttaataacagggtattttttgttaaattttatttaatattattagttaatatattaagtatatatcatttagtgtagttattaacgttagtagtgtgtaagtttacttatattaacttatgagtttgcattatgaaatacggaacttatttagctatggctagtcttttgatatgtattatttttgctttaatgttatatggtatattgaaaaagtgtagaacttctagagcagtactaaatggagttgatacattacctaagcatgtctatagtatttctaatagtagattacataattctattctttgttacttaaaagtaaaattgaaagaacagttaaaggatttttgtgatagaaataatgttgaatgtataaaagctgagtctgctcaatatggtgttttgatggttaaagttggatttgagtatgtgcagcatcaaatggcttgttttattagtgaaattcagaatgatgatatttataagaaagcattgttgttaggtaatgttatttctcaatctgaaaacttaatatttgcgtacagtgaataccgatatgctttgataaaatgtgaattacaaaacatattgtacgctcgtatttcattaagaaatatatttaatctagtaaaagatataaaagtaaaagatcagattgagttaatgaaaacatatcatgcaaaattagattgtggtttagcttttattgctaaaggacttggttttattatgaaggatgttggagtgttagatgaatttgatagtattcgagaactatgtgatgatggattcttgtatgatgatgactatttaacttttacttcaatatctttaaaaagtatcgaaggttatacacattaaaaggtagattttttaagatatattgattgataatgggatgttgacttattctgaaaactatttagtatagtgaattctataatcaagtaaagattttaatatatttctgtatgtaaggggtactgtctcatatagtaaatagtttttattttaataaaaattattaatattagatatgtatatcatgatttgaaagaaaagttgtatggtgtataaattacataattaacattaatcagagttattttgatgtgatgggtaatatgatggaaatttaagaaagttattgtacatgcgactgtgagttgtgtagtttttttgtaaaggcatatagaggttgtgtatgtctatgttataagtacaggaagttataagttgtatagtagtcatatttgtgaatgtgggcatcgttagtattaagttcatatcaagtatcatgacttgatgtagtatgtttacttttaatgagttcaagagaaagtctatagggggggagggtggcttgtagaatttgattttaggtctttaagatctttgagagaaattacagtaacttgaattatatgtaaatgaatcctaatttggactttaaagtaaatattgctgctacacaactttatttttcgatatagaatataaaaggccaatttacttaatagtgtgtgctaataaaggtataaatattaataaaaaatgctaataaagaaataatttatagattttttctcaaagttattttatgttcttagaaaagaaatcagtgagtttgatagtaatgttttgaaaaaaatcgatttttttactgcggttttgatgttgatagcaatttttgtaatgcttttaataatactgatagtttcttataatatatgttttagtagaagcatgtcaaaaatttatccagttgttcagaaagaggtaagtgttatgcttgatatgaaacttcaaggagctgatccgtcacataataaagatttcttaaaaattactaatgcaataaattatatacgagaccaaataatgttattacggtgttcttatccacataatttgagagttcaatgtgcaatgttgagtatgttttgtgtgagggcaaaagcacgtataatgggtttgtatcaaaatgaggaaggcttcagtgcagaggaaaaagatgagttatcaagtttacgaatgagtatgtacagagatggtatagaatatactacagagtctttgcaatatgatattattaggttactacagtctgtagtttcttgtattaacggtttagtgcggggtcatactttatttgtgtattatgaagaagaacagtggattttgtgccgcattaaagcagcatataaaatttgtcaagaaggtatgcaatctattaataaagaaaaaacagaatatgtacaaattcagtgtttattagctcctacattaggatatacttaatgtatattatttttgttgttgtaagtctaatagtatataattgttatttatattatgtgaaattcgaattcatgttttatttagacattaagtagaaatgttaaatctggtattacaaacctccagaatttttcctttcctttgctgattcctattctaggagtacatatataattgtctatattaatgtctgtgttacaaatacagaaattgtatttttgtgtaatgtctgtattattatgttcttttgttatttgtagaattttgcatagttttcctggaccattaataatagtattaggtttattttcagataataatactattcctcgaatgagtactgcagcagggaatccttcttgttcagtaacaacattaagacagtagtacattccataaataaaataaacgtaggaaaatcctgggctaccaaacattacagaagtgcgttttgtatagccacgtgcggaatgtgcagctggatcatcctgacctatatatgcttctgtttctgtaataataccttgatgttgattaaacagtaatttttttcctagtaacttgcctgcaacagtaagtgatgattgttcataaaaagacttttttagtatataatgtggcactgtgtatttttactagaaacggcttatttatactatactaatagtatatattatattgtcaataatgaggtttcagaatgagtgatcaggaaaaaacagataccagtggtaaaaaagtggataaattaaaaaaagttcataatgcggtatccaaggttgcacaatttattgtaggggagagtttaagtttacagcttaaggagtataaggttagtttttcttatattgttgataatactacagattatttgaagttaactaatgtacaagaggtaaaaatcattgaaaaaatcaatcaattgaagaatattaataatactctgttggagaggttgtttaatttttggttgcgtaggaataaacagctactatattggcatatgatttttttattggttaatattatcttgttgattcttaatggggataatctggttaaattatcaaacctgatagttgaaattcttatcaaatggaaggatggagttgtctctctttattgttcttaattttataattatatgttgagaatgtagatattttggtattaagcatgttgctgattattttgaaatgaatattttatttttgttaatatgatgaatgttatttttttactataagatatttgtacattctatataactgttataagcatagtatgctaactggtggtaggataatgtaatatacacgtaaatattgtgatattgagtatgtatttaatgtattagcatggtgtttattatgtgtgatatctgtattactgttggaattttaagatagtaggtagtaattcttgttttgtactgtgtagtttatgagaaatgagtactgtcaataataagtaacacaataacagttggtattgtagtgttatttaaaaaattatgctataattagcataatttaataaaataataacatttcagtataagttattgtttttttttatgatgagtaacaaatcctcagttgttgatgtattgtagaaataatagtgaatctggttctggtcaatgtggtatggtaaatgttacagaaagtgcttataccaattttgctgaacaaggcttagcattaagtgaagatatactattgatataataaattctagcgtgccagcaaagagttaataatgtgttataggataatgctacaggagtaaagtaatataatgcagaaattttttgaagatttaggaatacgataataactataaaattctataagcccattatggttacagtgtagatcactttaaaggcttataaagatttttttgatatggtgaataatatgaataagtgtggtgttattaaatcatcctccttgtgtaagttctgatattgaatgcatggacaagacattatctattatatagaaagatattgtatttaataagaatactatatgctagaatgtccaactaaaagtatctagataataatagtttgtctactgaattaggaattgactaactaatgatataaaaaatgtgggaaatttttatacataagtgttgtatttttatatgtggaaataataaaaatgcatcatgacaaacaaatttgttttttgttagtaattattttatgttaataagtcatgtgtttgactaggagcagtggtaatattaaaatattgataatagttgcttttggtgtcaagttattctataattaattagtatcgttctttcgggtacgtcatatattcaatatatctttattagtgttcttataaagaatactttttaacagatatctaagtaatacataagtttctttgattagtgtgttttaatatattgggggttatgattatgtcagagggtcttattgttgtaatagcattacaagtttttttactcttgctattgtttatttttgcgctctatcattattgtattaagccttgtagcaaatcaggcaagatgggctatgagcgatttgaaggtgaaaatattccaaaatacgaaggtgtgcttgaacactttgaagagatggattatctccagttacaacaacgtgttgctgaattaaggcttgcttgtcggatgttagacaaagaaagggtgacaaatgaccgtacttatgaagagtgtttggattggatgttttttgtgtctctgactcttgacgaactgatggtagagaacaagttggaatctgactatattacacgcatgcgagcacaataccatctgtttaacctgagaataatagcagaccaagttgctagacaacctgcagctaatgtggaaagacaagaagatctacaggaggttgagcaaagcccaagtcctcaagtggaaggtacatcagtagcgtcttgttgtggtcaagagaaacaagcagcttaatgagttttagcatatgtaaatccaaatgtttagtatttgggtaaggtattgactgtttaaataatcaaatttatgaatatgtagttgagagatttgatttctgctgtagtggtattattttattaaaatttacatatttatttttgttaaagttagaaaaatagagaattatttaatataattcgacattattgagctctatagtgagttttaggaattttagaaagtgaagatttgaagttattgagggtatatgattgtttaaatattttcaagtttatttattgctagtaaagtatgttgtgatgctcaagtattaccggtatgtaatttgtgatatgcttattacatttccggaacttgttaataggtatttaccataagactaataagatctatgaacaagttgtatgtaacgtttctcaaaatttaaaaggcattttaattgttaattattaaaggagattattcttaaataatgaagcatttataagtactaaatgttgtggacttttgtgattatagtaggtattctattgtatatttaattttaatacttaagttatatacttttaatatgtacaggagcaggagaatactgatataatagcaggatttttctaagtgtgtggtatttctacttataatatcaatattaatttatattagggcatgtatgggtactggagcaattattggtataattatagcaatacttttgttaattcttattgctcttgtattatatgttttattcaggacgtttttaaggcctgaattatatgtaaggtcaaatctttttccaacgggtgtggtgacaaatgtagacccagaaagagatctgcgttcatttattatgatggattttgaacgtcaaacagcagctaatatggtttctattgtacgagatatgaagtttcaaatatcttctattcggtgctatagagatatattatctagtctcatccaagaagaccaagatacattgcaaccagaaataatggaacaaatacttgaattgatgtatagagctcaaacgattgatgagcaaatacaggataggctaagtagcataggacaatttacattagacatggctaatgcagaagatattgcgtgtgtaacttgtaattatgaagcattgtgtaacattggacaggaaatagaagcatgtattcactcaatatttgatatagaagtgaatagaacaacagttgcagcatatactatgagcattcaacttattatgtctgaagctacacgaaaattgtttgttttggtaccaataagagacctagggttacctacagatgcctcgcatagtcaggcagcaagtagcatggacagataaattagttgtttaaaagtatttagtatagaaatttataagggtagaataactgtatgttgctgtatattgtattaggagcaatttgctattaaatcagattcaatatatggttggtatgttagttgaaatatgtatgattaaacaaatggattacgtaaaatagattacgtattggttaatgttatctgttgtatagagtgttaatgctcaaggagtgtttacaattcataatacagatctggaattgtatgttgtaccttttattatgtctgaatctagctaaaaattatttgttttgacatcaataaaagaccgagatgttacctacagaagaaggctcgcgtgttcatatggtcagggagcaagtagcatgaacagataaattagttgtttaaaagtgtttagtatattgaaatttataagggactgtatgttgctgtatattgtattaggagcaatttgctattaaatcagattcaatatatggttggtatgttagctgaaatatgtatgattaaacaaatggattacgtaaaatagattacgtattggttaatgttatctgttgtgtagagtgttaatgctcaaggagtgtttataattcataatacagacctaatatcgtcattgtatcttattgtgaagggtattttttatctattttgaggtacttttataaagtaaatattggttaggttgtatattatatacgaatgttagcttatagattagattttatttagtgtattattggttgttggttagcatgtatctgaaaatagctaatagtataatatattactgcttgtatattgtatttttcttattaagggatgtatctaaggtttgctgttctgagataaatcgtatgtatttgttgtggattgaatattagggatatattctggtagttaatgttatatagactcattctttttttgttggttcagccaaagattatttgatagataccagtctttacctatagatttattgttctctttttgttgcagcgaattttaagttacgtatttctcaaattggtgtgtaattttttgtattaacaattattgctgagtatattgttttacctaattaattattaacgaaaatacttattgcagaggggataatttactacagatatatcttgctataaaagtaagtttttttcttatttaaagaataattttaaaattttagttaaaatatgctatatacaacatattttatattgcatttttaataaatgtagtatatatgctaattatagcataaaaaggtttataagttatgacatcgaatgtgttaataattagtatgataatagtagtattactgattttttgtgtgatgttactatgcctcataataatctgtagtcagaacaggaatgctagtttagtagatgatcaacaagatcctgtcttatatgattttgaagaacactgtagcatatcttctagttcgtgtcatactcagagcgatagtacgctttctgaaggtgaatctgtagatgaggaacaggaagtcgatgatacaatgcaatacttgagtgactgtgatgactttgaaacggatagccttgagatacacgatgatagtagttcaatgaatcaaggacactgtagtttaggtgctatacctaagacttataatcctacatttatgcaaaaaaagactggatggattgaagaatctagtagtagggaattctctgatgaatgtttttcatgttctgatgtttcagatgacgatatgtctactaaaagtagtatgttgcttgattatgactgtcagaatagaaaaagtaatcctaatcatgaacttgtggtattgcgtactgataattctgatgtaagtactgtaaatgtcagtcgtgtaatgccaaatgggcgcataaggttaaattcattaggaggagaaggtgatcatctgacatcttatacatttggtttcccattacgttccagtagtaaacttgtgttaagtagttctaatcttagtttttcagagttgataataagtcctactatatatgcagaatttggtaagatagatcccttctgttttagttattttgaaaaagatatgttaggtagaatgggtggagtacctagttctggagtttatggtatagaaagtcatgcttgtgctaacagtttaatatcacaggatgccattttgggtttacgaacttgtgggaaattaaggaaggatacagtttttgttgttaatcaaggagatttaatagatatgaaagatcatatttctaatgttttacccagtgatgttaaacctggaatttctagttctagagagattgtaggtttaacaagtggatctgaatgtactgaagagaattcacaaaggattgttcaaggaacaggtgttagtgtagtggaggatgcagttccttctggatctagaatggtgtttgctagtcaagatgtggatgctatgtttgcaagtagtgttcagattattcaagatagtatggatttgttatctgatttttgtttggatgagatgactgatgatgaagttgaacagataacgcgtaatatggaacaaagtagtacgtcttgtgcaacagtttcagctatggcacagatggtaggggctagtaatgtttctgatggagctaatacagatgttaattatctatgtcaagaaggaaaggacagtgcgggattgttgctaggagaaggtgtatctaaggataagaagatgacatctgctgcatcaagaaatgtagtagttgtacaagcagaagtgcatgagccgagtactagtagttctgttgttcgcaaatctagaattccaattaaggttggtgagtcaagtagagtagttacgaagaaaagattggatgttaagcaaagtagtttaagtgtcacgtccaaaagtcaaggtttaggtgtgagaaagttacaagcagtagcagcagatgatcgacctaatctggttggatataagtttaaaagtggtgattatatgctatgtcagtctcctaagtctaatcgtgctgatgtaactaaacgtagagtatctcagagcggtggttctgtatcagtcaaaccttatgaacctgggcatactagggtggcagcgcataaagagtctcaaagtagtgatcatgtctcagttaaaccttgtgagcctagacgtatagttccgcaagtaacggtagcactaagaaaaaaacgagtggtttttcaagatacagggaaaggtgaagctgtgctcggaaggcatggtagtacacaagaatgtgtagagcctagcagcgtaacaagaagttctctggagaatgttcctaatgttgtgaaacataagtacgaagatgtttgtcacaaggattcacgtcatgatatagcattaaggagaagtgtatcttctgtccatcagcaaagttctaaatctgctagaagtatggctactctaggaaagagatctgcagctgctaaaactggggtaagcgttaggaggactaaaagtgatgctatagatactgaaaaagggcgagataagcgctggttagaaaatgaaattgctattccactagaaaacactgtaagccaagtagtgatttgtgggactaatgaaacattacatgatacattaagtaaacattttagagtactacatgattcattgtcacaatacagtaagaattcagatgctgttgttcgatgcaaagaggtatattatatagcacattcacgcattaaacatgcagatagtattatacaggaggctgttgataaatgggcgttaacgcagagagctacactgtgggataaacatgggaaaaaagtagttactgcgtgtatgaaggatttggagaaagtttttaagaagatttatatagatcaaggtaaaacttctcttgattgtcaggcaaaacttcaggatatacgtagtgaagtggagaacaatgtcaaaaaccaaattgcttgtttagtgagagatacattcttaaaaaatgcatgtgatgagatttttactgaggtatcatctactatacttcataaagtgtctgttgcacatgagtcaattgttaaaggaatgagaaaatgttcgagagaagagctggaaggtcaagtagtaaagagttgttctatattccataagagtaagttgcaatctaaaatattaactcatataaatgatttaggtacattttttaagaaacaactgcaagtaaaatctaaggaaatagtaaaagaacaattgaaaaaatgtaaagttgatattgttcctggtgatattaggcattgttgtatagatacagtaattaatgctcctgttcctaatactgctgctagatatgcaattcatgtattgaatagtagaccaaatgttagtgggcttgatgcaggacaactgagttttagttaataattttagatattataaaagcatcagatcttaaaaatgatactttttattaataatattttatatttattataaaaagtaaatttttatatagatcttgatgcttttttatgttacgattaatttattaataaagtaattattaatttaataattattaggcttttgatgtttgcagagtatattgtagatgtctgtggtggtttgaaggttatattatcgtacgtttacctatttgatatctagtgatgttttgtagtaagtgttagttagaaagacttaatgattctatagttgtagaggttaaattctaatattgaattagttatggtggtttaaaatcagggttaaagtaaatcactggtgctatttatacatcatcttaattaaggtagtggaaatactttttaaaattaatctgatgtaattgatagcataatgttgactagatcaaatgatctactgtttttaagttaatgtgcttgataatttgatatgtaaacatttctgtttgagccagatattaataaagattattggtttttatatttatgtagtgagtttatgaattattgtaatctattagaagtggtaataataatactgttaatgataatgttatccttgttgatatatgtaatgagtaaaaaatgttatatgactgctgccattacagttggggaaggtgaagatatacaatcagtacaagcaccagaaagaaatttgagcaatggtgttagtaatcctagagttgttaatagtattgattctagtagtaatatgagtgctgatagtgctagtgatatgggtgctgatagtgctagtaatatgagtgctgatggtgctggtaatatgggtgctgatggtgctggtaatatgagtgctgatggtgctggtaatatgagtgctgatggtgctggtaatatgagtgctgatggtgctggtaatatgagtgctgatggtgctggtaatatgggtactgatggtgctgattctggtagtgatatagatactgataatagtattggtagtgatgtgatagaaggaggaacaagtggtgatgaggaagaagagttacattcagtagatcagcacatggtaaatgttggtaataatggtgtcatagcagtagaaccacaatctagtatttgttttagatagaattaatattgagggatgtgttctaaagtcgtttaatatgacttgcaatactttatagtctcagagcactaaataacaactgtttttggtatgtatgtaaatgtttctgtaaacaaagtgttagtgcttttatacttaagtagaaataaaatagcagatcatatttatgtgtagtttgagatctgaaatagttaatgaaaagtttttagaatttaatatattaattttatgtttatgcggtaatattatgcatacagtatgtaaaagatctcaagtattctttttgtagtaccatttatagtagtactgttagcaggattggtagttctcatatgtgtgagtgtgaactattaatcactagaagaaatgttttaggatagtagatccacgcaagcgaaaggtttgtctagttatgttaatagtagtaatgctgcaagaaggatgacaagtgataaagaaaataataatgttcttgaagagataggccatagtacggagttgaagtctggttatttaggtcggaaagtaaccaaagataatttttcaaaaagaaagccttattatttaagcatagaattacacagtttgtgtggtgctaaaagaaactagggtgtgctatgctgtttgttatgctatctatgtgttctgaaaatttaaacatataacattcttattaaatcaagtatttaacttattatcttttacaatagcaagtagagatagaaatgtattggtatatatctaggatatagaaattaattttcttttttcaataacgttatataggaaaaagtttgtattgtttgaatagactgtttttaggggtttgttgattataatattatagcatatagatgttatttttcaatatttttgaagaaagattaatatgtatttagataaagtttagttctgatattacatttgttaatattgttgtggatttctgttgattaaaaaagcatatattctagtagtaaatttcttgcagaagatttttaatatatgtaaatttattttaagagtttttaatatagataaaaaaattaatatattagagacctttttataagttttatcaaagattaatcctgagttagtgtgtattggggagatgatggatttattatagaaaattttaacatgtgggtagaaagtcatgattacgaataggagtggaagtgataggttaaaacctggtgcatttttaggaatttcatcttgtgttgatcatagattggtaaggcctggatatataaagaaaatggtggattcattaactctagagagacgaaaactagaagaggctagaacatcattaataatgtatgagtatagtttacagttttacagtttgctcatcctattttttaaagtgttaagaaataactatgggtcaagacaaactttacagaaacatattgaaatgaggggtattactaccttgctaaagaataaaaaagtgttgcttaatgatgcttttgctaggaagtttattaattgtatggtgaataaagttgtaggatttattatagataaaaagcaagctcaaaagttgtgggttgagaaagaagagtatgcgagggaaatttgttataaagttattaatgatataaataagaaaagaaaaagtttagatatacaaaatcttacagaagaggaaatagtttctcaagatgataaaatggatgaagcattatttggtgcttatacagaacaggttagaattttttctgaagtgaaggatcagcagcaaggttttaatttcttgaaatgtattccttctttatcagaaatatttgatgctagtgatgttttgagaagtagtgagatttgtagtagcataaggagtgctgttgaaatttcgcgtgttgatgcaatagaattggaaatgctacttaagtatattattttgggaaatagtgttgatgtgataaaggtgaatttccttttcagtgccttaaaaaattgtttgaagaatatctattgtaaaattgctgaaaattttgttgatgtgcgagaatctaggtcgtctagtagtgatatacatcaagtgcaattacatgagcaaattggtgtaatatgtaagaatcttgttaaggtttctatgccagcagaagatatatgtaatatgtatacggagatttattacacattatcattgcgttttaatatgataagtaaagaaatagaggacttattaatagcagtatttataggtaatgaaaaaggtgaggttgaagaatttaagaaaaaggatattattagatctctttatgattgccaattgaaatcaatttattcaataatagaagcagattgttgttgtgctgatttgttatttgtaaatagaagggtgaaatctgtaataatgagcctttgtgtgcaaagagatgatattatagatcacatgtctaatgttgaaaagttacttatttctgctgctaagtaccaagatattgtagctgattttgtctctcatgatgttcctgtaagtaatgaagatcttttattaaaatgtgataatattacacaattaaagaaaagtttaaagtcaggagagagagtaaatagtagtgtagccacaattctgacagaggatttaggtgttatagatagtcaaatacaaaaattagaagaaagcttgaacatgttaatatcccggagatgtgttagagctggttcttgtattgtatgaagtagattatcttttgatgtttaaagtttataattctgtgatatgagttagtgcaactttagtgttataggatatgtgttttaaggtataatgactttgaatactgtgaatcatattatgaaagtatgtaaataataagtttggaaatttttgtgtaaagaattgatagaataaatcatcagggatataaggtatttgtagataaaatttgctatctcttaaaagtaggtgtttttaattgttagtgctaaatgctactaaagatttggtatggcatttaatttatgtgctacttctctatatccttctattacatttcctaggttcaaacggtaacgatctttgtcaagtcttttgttagtagatatgtcccagagtctacatgtatctgggcttatttcatctgctaaaaataaatctgattgttcatcgttgtgcaatttgccaaattctagtttgaaatctactagtttgattccaacgttgaaaaaaagctcactgaggatattgttgatctttagagatagtatttttattttctctaactcttgatttgtaagccattggaagctcagaatatgtccctcacttaccatagggtcagatagctcatcatttttataataaaattcaatgatgggagatttaaaaggggtaccgtctgctatttgaaatcttttactaaaattaccagctgctaaattccttattacaacctcgattgggattattgttattttttttactagttgttctctttgatttaataaagatataaaatgtgttttgatacctttatctataagttttttcattaagaaactgcttatatagttgttcaatatacctttttcatggataatagctgcttttttattgttgaaagcggtaatctcatctttgaaatgttgtattacttctagagggtttaacgttgcaaatattatttttgcttttccttcatagattttttctttattttccattatatattacaaagtctattaaactttcattttatatatttgtagttaatttagcaattggctttttaagttttaagtaagtgtatagtgttatcattattctagaatatttaaaatgtgtgttaattaatatggtaatatgtagttcgagtataatacgagtagattgatgtaaggtagagttttatgcagcgtgataagttaagagaagtaaggggtaccaaggatctattagggattgaactttataagtttcaatatatacatcgtttatctcagtcaatagcgcatagatatggatttatagctgttgatactccaatcattgaatttactgaagtgtttactaagactttaggtgatgattcagatattgtaatgaaggaaatgtataattttcaggataaaagtggtgaaaatattacattaaggccagaatttacatctgctattgtgagggtattaattaataaaaatttaattattcctgtcaaattattttctagtggaccagtatttcgttatgaacgtcctcaaaagtgtcgtcaaagacaatttcatcaagttaattttgagttttttggaagtgatcttcctcttgcagatattgaaatgatagcattaggctatcatattttggatgagttgaagttgttagatgatataacgttagagattaattttctaggtgataaggaaactatgaactcatataagctcagtcttatagagtatttaaacaaatataagaaagatttatcagaagatagtcagcgtaggcttattacaaatcctctaagaatattagattcaaaagctccagaagatcgtgaaattttattgaatgttcctaatatttcttatttttatagtaaatcctctaatgatttttttgcagaggttctatatgggttagatgagctctgtattccttataaagtaaatcatagtatagttagaggtttagattattattgtaatacggtgtttgagtttacaacgtctaaattaggagcacaaaatgcagttgttgctggtggtagatatgatggattagtgaagtctatgggaggaaatgatactcctgctgttggttttgctatgggtgttgaaagagttagtgcgttgatagattataaacatcaagaacctaggagtgtagtattgatacctatagggaaagatgcagtatcctatgctttgaagcttgcttatgagttacgttgtaatggtatttctgtaaactggaattataaaaatgctaatttgagaaatgcattaaggaaagtaggtgatgataatatagtgttaatttttggagatgaagagctaaaaaataatactatacaagtcaaagatatgaaaactggtgaacaacaagaaatagttagatgtgatttattggacacattgtgtaacaaaatttaacagtgtttgtcaagttatgaaaaaagcgtaaggatttagttaaaaaatttctatttttatttaaatgtgttattatttaaagtacatctgaaaaagaagagagtgtctttttggttgggaatttatgtattgtatagacacaatgtaatcattttctatttttcaataattctaaagtgggaggtatagcatgttaactaataagtttaaacaaagtgctgtgatggctcataacatgagttatttagcatatttttgtagaagtatgggattgtctagtgaagacacattaggattattgacaatactagaatccttccatcaaaacgcagcttctttcctgatatatgatttggacagatgtaatgttgaaagcaatgatcatatagattttgtagtgaaagattgtgatcataggaactatagatgttatgaccatgtatcacaacaattagagactcaaggtcaccttgagttagcatctatgacacgtttgtggaatgttcaaatgtatttactgttgcgtcttcactctcttgctgctcaatatgtactgtccacacggcattatactgatgacgaaatagtggaaggattgttatctgatctaagtcgaacttgtatgtctattatgactcggggaaaaacaagttcagtcactcctgaaaatgcagaagcactaaaggtgtatggtgacaagtttgtccagagactttttggaatacagactatggatatggatagtatgcacagtatattgcatagtatgatctgtagtgttagaggtagttacttacaagttatagaaggcttagataaagtacaagacaaagaaacgcttatgaaactagttactcttgttgtgtataagagtgctataagttgttttatgaacataaatcctgattttttcagccaaacattgaggaaaaaagcttactctgttctccatggatttatttgtgatggtacagacaaattacctatatcatgtagaagtcgtcttggtatgggcatggcaccttcacttgttcttttttataagaatttattttctgtatttcatcaaggaagtatatctgattgttatggtgatgaaattaggtacaacatatctgtatttaatgatgtatgtctggcaacaagaggatcgttagctattgttgctaatgagcctgtaccatacaatccgttttcttctcgtatgactcattttgcttattatgacgctactttggcagttaatgggatatttcatcacccaaaacttgataatgtattgaaattggaatctatgacacaaatgtacaagatgtcattagaagggaacccatcagacttacactgtttgtttgtatcgggattaggtaggatgaatttttcctttgaagataaaggagagcctaattctggacttgagatgttatgtgagttgctgtctatgtgttactatgctgtttttgttgcaagacagccattgagtgtagttagaggaatgtttaatatatgttatgggaaattaggtgatcttggtgataaggtaaatgtaggaagtgttgcaggaagtaagttagccattgaaagttatagggatgcttttaatgctgcacaagcagcattacattgtactggaattaatccttcagacgttatttttaagaaagaaacacttttgatattagtgcaacatttattattaggtgaagttgcgcaagaaaagattgaggactcaaaattagcatttgatatatttgagttatgtaaaccagtgaatgaagtaaaagctcagcaagcagcaatgatgatgtgtcaggcattcaggggatctaatggtgttgtagatggttatgaagtaggaaacttgggtgcaatagttctaaaattgctttttggtaattttgtagaaagaaacctgattttaaagttgttagatattacttgtgtagcttgtgatcgttataaaatgcagggtgctgtacaggatatgtacaatgagttattgaaagatttcatgtcttgtgctgatgtttgtttgagtttattcagatatgcaggtagttctttacctatgtgttatagttcgcaagtggtggcaggactagacggtgatagttgtgcagtatacagtcaaatgtacaatatgttatcatcctatgcaagtaggttaaatgtatctcaagatgatcttattagggcaagaaattcaagatttagtgttagctttgctgagctgtttagtaatgcggtattaccacatggtgagcaatctggtccagaattgcaagttaatccttgtgatggcataagtaaaccagagtccatggccttggtacagatgcttgcatcttatgtgtatttatataattcaagtgagataaaagaggagttattgtctgcgaagttatcttcaccacagttcttattctctattattttggtctctcctagatttgctgctaattttataaatatgtgttatgaatcttcgacaaagaaagattattcacctcagaaagctgtaagtgcgtttcttaatcgtattagtaatatagggggatctaggacatctagtgctgaagctatcgatataatgactggtcaaggtaataatgttattatggaaaattttattagatcatgtgttaacgaagatggcagtattaatgttgaagattcaatacttagggcagcatgtttatggattataaaatcgaacaatttagtacataaagatgttatacaagatgttgatgatgctgattgtgcaggtaaagttagtccagttgttatcgattctgtgtcattatctgaagttttgctaccggtattatcaaatccattagctctagatgatccggaaggacctgtgtcattttctcatctcgtttatagtactggtttattagataaatcaggtattgagagtgcttctgcgactgtaggtaaattgcagatacaaattcaggtggatgcgaaatgtgagacagatgtaaaagaagtaggtcctagtgatgataaagtcagcgagatagtagaaatgaaagatgacgtccaagaagtagaggtggaatgtaaaacttcggacactcaaacagtagcaatagaagatcaaactcagagatatgaagattcttatgtcgcacgtgatcctggtgatgtgcaatcaagtactagtgacatttttaaagagaagaggtcttcaatttgtaattatgcatctgcaatatcagcagctatacttgctgtttctcttacattaatgggaatggcttttgcggtaaatgatgaaggagcacgaatagcatgtatcgctttatctatgacttgttttgttatatcaatatcaatgtttcttatgacatgtataaacatccgtagcttaaatggacgtaatgaaggtcatgatgatgatacgcaacgcatactaaataatgaagttgtaaatgaaacacaagatgcaacaatttttccagtagacattaatacacgtcctaagacacattagaaagtcacattctgctttaaaaaagcctttatccttgctcatctattttacttcttaaagtagatatatcagctgctccaccaataaatgtatctcctattataatggcaggggtgccccttatgttaatgttttgagctaattctttagtagattgtatcattttttctatagtgtcggaattcttggctaatgaaactttaaaatcttcttcagcaatacctattgatttgactagacttagtatagattcatcgttaaattgctgcttatggtttagtgcagcatggtagaactcgatgtatttacttgggtttattagatgtactgctagtgctgcttgaacagctttcagtgatgcttctccaagtattggaaaatctctaaatatgacacgtactttaccatcttgtattatttgtttcatatcttcagacatcattttgcaataaccacaagagtaatcaaagaattctacaaatacgattttactgtctttatttcctgcagaaggatatgagctatcctcaagttcagatttatacttttttatgtttttactcatttcttcattttctgcttgtgcttgccctctagttaggaggtcaatgactttttgagggtaattagcaatatattcttctacgattgagataattgtatctttatctattatagttttaccagatttgctagataaccaattgtttattaacggaaagcttgctactagtataactaaacttaataaaaataaaatccttagcattattaaccctaaaaatcatagaatgctaaagctactataaatttttgatgaagtcaataggagaaatagctgaaaatatagtgtaaatcataaaatatttaatgagtttttcaatgtttgtcagttgtaatataagtaaactatacatcggtaaattgggttcttttatcgtcaaatgttcagatagtgtcaggtaatttttaaagtcgtgaaaattacgtcataatgctataaatttttgtgtaaatttacataattctataaggaagagtctcatttttgtttataatgttgaagatatattcataggtttatgatgaaaattgctagtgataatagagaagtatgtgttggtgtgaaaatttggttatgtatatgttgtatagggatattgcttatggtgttagttggagggataacacgtcttactcattctggtttgtcgattactgaatggaatcctgttattggagtatttcctccaattggagaaagagcatggattagagaaaaaataaagtacatggctactccagaatttaaatatctaaattttaatattacacttcggggatttaggaagttatatttgatagagtattttcatcgattacttgggagaattgttggactaacatttttaattccgtttttatattttacatataaaaaaaaactacatagaaatttgataataaatttcatagttatttgtttgttaatactgtttcagggagttgtaggatggtttatggtaaaaagcggcttaattgatcgtcctcatgtaagtcactataaattaacagctcatttattgttagcattgttgattttctatcttttgtggagacaatttttattatctactatttctaaagtaacttataacattaaagtcaatggaacattaattttttctgtaattagtgtattaattgttactcaaataacatttggttcattagttgctggattaaatgctggattgttggataaaactattccttttttagcaggaaaattaatgttagaagatttgttattcataaagccattgtggtataatatttttgagaatcctgttacggtacaatttatacatgagctaatagcaactcttattttcttagtagttattataactttgttaatattaagattgaatctttttccagcatatttactattaatatgtttgtgtcttcaattaacattaggagtactaacatttatatataatgttcctatagttcttgcttctttacatcaagtaacagcttttattttatttgctgttaatacttacttgttacattatatgaaattatctaagttacaatatgttaaataggaggtttgtgtgcttgatagatgatacaaggaatgcttgtaatttcatatctttgaattaagtaagttgttatatatgttataagttagttttgtactttttgttgtacagatagctctgaagttttttagagtaatgatgaagtattgagtaaataataggcttcctgttgggtaaggcataaatatatgttgtgagttctaagattaaaaattgttatgtgtttttgactatttttatggtatttctagtgtgttatttagtcactgattgatatataatttaaattatttaatatagctttgagggtatagtttggtgttttaagttacaatcagtatagatagagatcatgctgtaaactattagattgctgatttttaaaagcttcaaggttgataacttgacattctccatatgtttttacttcgctgtggtcagatataattactatactatctttttgttttaatcttgtaaaaatgagttctaatattaattcttttgtattaatgtcaaggtgagcaaagggctcatctataatccatatgttggtgttatatattaataatctggatagtgcgactcttcttttccacccagatgataaatccttgtattttatgtctagtattggttgtaatttaaaaaagcatattgtagctgctattaactcatgggtattttttaagttagcccatagttggatattttctaggacagtgaaattgtcattgcaaaagtttttgtgccctatataagtaagagatgtaaaatatgtattggaatcgtggatgttttttccattatattttatgtttccatgtgttatggggactagtcctgcaaatagtctaagtaagcttgttttgccgcttccattattccctataactaatgttagtaagttttgttgtgtactaaaattaagctgggagaatagatatctattatttctaatgcaagcaaggtcagtacattctagcatgtttttacgtaagtgttacttaaaagttacacttatacttccaacaataaatttttgcaagtagattaattatatcataacactaaatattatatgtttatggccattttataaaacattagaagtaggttgctatatactatgataaaaggcttagatatatagattagagttctaatctatatcctggtacataattcctaactgttgtttactattggtaaagttacgtctaattggttcatatattttccctgcatttcattgtaggataagttgcactggctatctccttttaagaaaataaactggcacgctccttcaaaagcatagatttttgctggaagaggtgtggtatttgaaaattctaaggttacatatccttcccatccaggttctaggggtgttacatttacaacaattccgcatcttgcataagttgatttaccaacgcacattacaagtatgtcctttggtattttgaaatactcaacagtttttgccaatacaaaactgtttggtggaatgatgcatacatcttcttccttgtctatgaaacttcctagtgggaaattcttagggtcaactgttactgaattaacatttgtgaataccttaaatttattatctattcttgcatcatatccatatgatgataacccatatgataaaattccgctactcctcttataatcgataaatgggtcaatcattttctctttaatagccttatctttgatccaatgatctggcatgactgacatgtttagttcctcgtatagcacttgttaaatggtgaataaaacatttacaattaatcattgattaatgcaagttaaaattacttatgtatattataatagtgtgtatgtagtcgaagatgatttttaataataatttgaatgttatataataatactcaatgctagaaagtcagaatatattgaatattaatattgcaagatactatgcatataggtaaacaattcactgtgtttattgattatggttgttattattttaacagttttgtgtaagatcattaacctgtaatttttggcgtgcttatttgtataagcatggtaatttggtttttcaataatttttttctgtggatagttatagattacaattctttagctatgttgggtattacaacagtgtttcgatttttatcaagctttgtaacccttgtatgtaactaggatattgtaatgatatgtttaattcattttttatttttaaattgcttaccagttttctttcagaataaaatcttttcatgttgtctgataaatcttcaaagtccattggttctggtgtattaatatttaatagtgcagctccatacttaactacgtttgagtatggtgatggtaaatcatctgtgcagttgtatatgctgccggggttaggattatgtattgatgtaaataaaatatttgctatatcatcaacatgtatgcgagaaaatatagtatcactaatagtatatttaacgttaccttgtattaaattgcgtaatacgttcctagttggaccatatatacctgagagtctaaagatatgtgagggaaggttagaattatgccacattttttcctgctttagacgattaataccgttaggagttgatgggtttgttgaagatgtttcatcaacccaattgccattatggtcaccatatacatttgttgctgataaatatcctaaccatttgatttcttttaaaaaattgtagtatttttggagaatattgtctccatctggtgggattgatattagtacatgtgtcacatcagagaatacagattctggtaatggaaaattgtaatctaataaatgaacatctttattatctgtatgtgctactttgttaaataatgtaccgctaattttccattttaggggcagaagtttttgtgcgaggaatctagctgtatatccatatccaaaacaaaataaatgcataatttaaactgagtacaaagtatgtgcttatatacttggttttaacaaaaatcaatcgaattattatatattatttaacgttaatatataacttcatctggctagtaataaaaactgtataatatatatttgatctagtgcaaaaattaatatttttcttgcaaaaaatatattaacctctaaccttgatctaacatggtattgtatgttttagtacatgttattattaactagtatgttcttagcagtatagtctatgcgtttattttaatttttaaggatttttgaatgtctcaacggttagtggatgattcaacttacactggatatgtgaagtggtttagttcagaaaagggttatggttttatttgtaaagatcaaggtaataataagataaggaatattggtcaagatattaaggatatttttgttcatattactgcattgcaaagaagcaaaattgatggtttaagagaaggccaaaaggtaaagtatcagcttgataaaaataatggtaagttttcagcagttaatcttgagttgttagaaggttagaatcatgtaatgcgctataaatatttttattatattagaaaagtttatagcgttctttttataatattttagatgtaggttcttttagattattatcggttatgtaagcataagggctgatcttttacatttgttatgaataatttcttcagcatgtgatatcctaatgaaaggctggtttataaaggtatacagtaatataagtagatttcagttttttaaaatcgttgcttcgttcttagcaatatctgttttcttgtttttgattataacatactgtgttgtttttcatcatgatgatccccttgggcctgatcatagtagggctataaagttagtattctttgatttgatattatttctactgttgattgctagtgtatctcataagttgattaatatgtggatacgaagaaaaaggggacatttaggttctcatttgcaaacaaagattattctaatgttttcagtagtagctgttattccaacaattgtgatttcaggtttttctactttgttttttaattatagtattcaagcttggtttaataaaagggttgaagctgtaatgcatgagtctatccaagtggcagaggcttatttaagggagcataagagaaatattcgttctgatattttagctatttcacattatatatctgatcacaagataatattaaattatgatacagcagcattgcaaaatgttgtgcaatctagggcagatttattaggattggctgaaataataatttttgaaccaagtaggatagtagcaagtaataagtttagttttgtattaaattttgatatggtcccatggaatgacttagatagagtggataatgataggattgttattataataaaagaaaatatgatacgtgcttttcttttacttgatagattctcatctacttatatcatggtaagtcgtattatagatagaaaagttatttctcatttatcagcaacgaaaggagcagttaaatcatatagagatctgcaatcacagatatcatcactacaaatacagttttctatgatatttattttaatatcgttattgttattattgactgctatttggtacggaattaatttttctggtgacatagttcgtccactgttggatttattctacgctacacgtaaagttcaaaagggtgatttatctttcaagatagaagaaggacgagttggagaagaaatgtctacgcttgcacgtgcattcaatcaaatgacgtcacagcttagtagccaacgttcacaattgataaaactttatcaagatatgaatgaacgaagagaatttatagaagctgttttgtcaggtgtttcttctggaataatagcagtaaactgtgctggtataattactttaatgaatgataaagcaaaggaattattagctcctaatgatatcctacatgcagaacttgatgatgtatttcctgaaatatctgaattgattaaaagctctaaaatgcatgatgaaattactgttttgagaaatagaaagtctttcactttatctgtgagaataaaattgcttggtagtgttaataaaggatatattattacatttgatgatatttcaagtttagttgatgcacagagatcagctgcatggtctgatgttgcaagaagaatagctcatgaaataaaaaatcctattactccaatatatcttgctgctgaaagattaagtagcaagtatcagcatgaaattatttctgataaggaaagttttggaagatatattgatacaataattcgccatgtgacgagtattaggtgtattgttgatgagtttgcaaaatttgcgaaaatgtcggatcctgtgttaattaaacatgatatttgtagtgtagtaaaagagttggcgttttccgggcagtttagtcgtggtgttgtgcattatgagttagatataccaagttatccaatttttgttgtattagataaaaatcagataaatcatgtatttattaacttgttcaagaatgcatgtgaatcaattgatatgaagtctaatagtatacagggactgataaaaattagtgtagttgatgatagagattgtgttaatgtgcaaattcaggataatggtgtaggatttccagaagaacttatggaaaagcttacagaaccttatgttacaactcgtgtccaaggaacaggattaggtttatccatagtaaaaaagatactagatgaacataatgcaacaataagtttctataatatagaagatggtggtctggttaagttgacatttgtaaaatgtcaggattgtgaaaatatttaatgtaaatttataatatcctattattagcagttttgtttatcattaaagatacgattaatattaatttgctcaggtcaattttagatagttttcaagagaaataatggtctaatataaattgataatatgcgtgaaaatgttagtattttattggttatttttaatagatataaaaagattttatattaagtatttttgcactgaaattataaaggtttaaattgtgaagaagaaaataagtatatgttaattgatactgtcaaagaattagagcgtttgtgtaatcagctgcttgtattgcaacctaaatttattgcagttgatactgaatttgtaagaagtagtagtgaatattatcctaaattatgtttaattcaaattgcatatggtaaagaacagtttgttattgatgttttagcgaaagatatggatttatcagttttaggacatattttttataatgaaagtataataaaagtttttcatgattgtagacaagatatagatgcattgttaacaaaatttccagaaattcctagccctatatttgatactcaaattgctgccatgttttgttgttgttatgataatgcagttggatattctaagttagtagagcaatttttaggtatttcattagataagctgagcttgaaaagatctaattgggcgcttcgaccattatctgctgataaaatccagtatgcacttaacgatgttatatatttgtatgagctttatcaaatattatataacaatttattagatgctggaaagttaccttggtttttggaagagatgaataatatagtgttacaggaagttaactgtaatgatgtttgtgatattcctgattttggttctgatatgacaaaagaggagattattgttgtaagatctgtaattgaatggcgagaaagattagcaaagttttttaatcttaatcgcgaatttatattaaaaaacaaggtaatgctatctttagttagagattttataaaaaaaagtgatattagtactttaggtaagtatataaagaaagaatatttatcatgtgatgcagtgtctgatcttttacaagttattgataataatcaatctgttaatattgatgagttacattatgtaagtgttaatagttataataagtctgttttaaatgtgctgcttatattgttatataatatgtgttacaaaaataatatctcacagaagttagttgcatctaaaggtggcctaattaggtttcttaacggtaagtttagttatgtaatgaaaggttggagatatgaattttttggatgcgaagttgagaaatttatgcaaggaaaatctaagattatagtctcagcacaagtactggataatgattgtatggatattgtaactactttgacggaaatgtagacttgttgtaaagtaagaactctgatagatattataggatactgtaattactggagaaacgtatgttagtgcagtaatagcataaaaaaatgtatgtgtttctagttacagagtagttgaaagtttattgtgtgtcatggtgaaaaatccacattatcttgtataatctcatgtaatgtaaaatttactgttttacgtgttgaaaagggataatatattgtaaaataagtatttgtgttgcggtcaaatatattataaagactttgtgagattgcttattattaaaaattgtgtgtttgagtgaaattcaattttcacttgattgggtatattgtaaccataaatcttcagttaaaatctgtacattgagagattgtgcttttttatattttgatcctggattgtttcctgcaattaggaaatctgtattttttgataatgatgaagaaacttttgctcctgcagtttctgaccttatttttgcttcagatcttgacatacttgataattctccagtaaaaactatgatctttccatgaatgagtgatagataagagctagactgtgtatctgttattgttaggtgttttactaaatcattaatcatatttaaattatgtggttgactaaaaaacattttgagtgaaccaatagttttggaccctatctgttgtatgtttagcgagtaatcttcattctgtgctaacttgagcatctcattataccatgtttcatatgatgaaaaatggttagctagtatttttgctatgtactttcctatgaatcttattcctaacgcaaaaataaaattttccaagctgattactttactgttatttatagcagaaaataggttactcatggatttttcaccccacccatgtaatgactctaattttacgtcactattacttattttttcttctaatgtgaatatgtcggtaatatttgttattaatctttgttcatagaaaaataagagctgttttttcccaaatccaataatgttaaaagcgtcttttgaaacaaaatgctttattttttccaggatttgatctttacaaaataattcaccagtacagtatattgatgcttcttgctttgcttgatatacactactaccacatgatggacatgttgttgggaaaacgaattttgttagttcttgagttcttaaatttttatctacatccacgatttgaggtattacatctcctgctctttttacaataacatagtcgccttcacgtatatctttacgctctatttcatttttgttgtgtaaacttgctcttgtaactatgaccccaccaatatttataggagaaagttctgcaatgggtgtaagtacaccagtcctgccaatttgtatggaaattttatttaattgggtttttgcttctgcagcaggaaacttatatgctatagcccatcttggtgatttacttgttgttcctaagatatgttgtgatttgatatcgttaactttgtatattataccatcaatatcatagttgatattacttctattgttataaacttgattgtaaaaattaaaagcctcttcaatattatctgtagtaatagtatgttcatttacacaaaagccccagatttttaattggtataataattcttcttgtgttagacatgcagtgttgactattgtatacataaaatattttagtttacgttgggcagtaatgttatgatctagttgtcttacagatccggctgcggcgttgcgtggatttgcaaaattattcccatcattattaagttgtataaaatcacagcgatctatatatatttctcccctgacttctagaagatctggtgcattgtgaataatatgtggtagattttttatagttttgacattggttgtaatattttcaccaaaatatccattacctcttgtggatgcttgatagatttctccttttttatatatgacggaaaatgatagtccatcaatttttaattcgcaagataatggtattgattgattgtcattgatgtttaagaactttttagttcttgtgatgaatttctctacatcttgttgattaaaagcgttatctaaggaaaacattttctcttcatgtttaaccttagcaaactttgtgtctggagaactacctatattgttttggtaatcgttactttgtgtgagttttggaaaggcgttaagaattaaatttcttttgcgacataactcatcatattcagcatcactgatttctggattgtcctgtacataataaagaacatcatggtgctgtatttgcttatttaatttatctaactctaatttagctttttcctggtcgaccataattagtataaataaacaattttgtgctattgagctacaattaaattatttttactaagtaattcttgtagttctccattgtgatacatttccttaactatatcacacccaccaataaattcacctttaacgtatagctgtggaatagtaggccagtttgtaaattcttttatagcttcacgtaattctaagctttctaatacattaatgctcttgaatttaacattcattttttttaagatactaactactacactagaaaatccacattgtggaaaatcagcatcacctttcatgtataaaactacatcattattttctatatcatgttttattttatccattatatcatttgtcatagttattacttacatcctgtttgtatttgtattgcatgtatgtttaatccgtctagtactttatatatcattctatgttgttccaattttgactttccttgaaactgacttgaaattactttaatcgagtagtgattattatcacctacaaggctagtaacagttatttcagcttctggaaaagcattccttattagaagctccaactgagattgcgtaacagtcattatttaacaagatcatagattgatataaaactttttactataacatgttttagtgtagaggtaaatagttttaaagcaaagctattgtatgtaatatatgatggtcctatgacttttatagttgttgagagctatgcttattgttaatttgtgaaagtacatattatgtttgggtattaagatattattatttatgagtaatatcataaatacattgagcatagcattattgtataatctttagtatttgattttcccatgtatctctagatacactaccgtgtatgtgtagtaatattttgccatttttatcaaatataaaagtttcaggtactcctgttactcctagtacatttccagttttacctgaataatcttttgctattttggtatatggatctccatgtttttttagccattcttgtactttatattcagtatcaaggtaatttattccgtatatttttattgtttttttctcagcaatttctaaccataaactgtgttcttcttggcatgtcgtgcaccaagaggcgaatacattgagtatgtatggttgtccaattaagtcgtttgtatcaaatacttgatcttctgtaaaaagtataggtagtactactctgtttgtagtatcagtgatagtattttggtttaataaaacttttgtgagtatcacggtaaaggttaagaaacatactagtaaagctgtagcaattattctcatagttcaataagatatttttttaatgtttttatatgacctatttctacgatattgatatcggaaaagatatgtttattattaagtggaataatagcttttgtaaagcctagtttgtgggcttcctttaagcgtgcatcaatatttgatatatttcttacttctcctgacagggcaatttctcctaatattattgttaaagatggaatagctatgttaataaaacttgatattaaggatgctgcaatggctaaatctgcagctggttcacatatttttaatccaccagcaatgttaagatatacttctttatctcctagaaatatgttacattttgcacttaatacagcaatgatcattgctagcctattaacatcccacccaactactgctcttcttggggtgaccatatttgtatttgcaattagtgactgtatttccattaatataggtcttgagccttcaatgccagcaaaaactgcactaccaactatattgttgttctgtgacctagctagaaaaagagatgaaggattttttataggtattagtcctttatcagacatctcaaatacacctatttcattagtaggtccaaatctattttttactgtgcgtaaaatacgtaattgattattattttctccttcaaaatataatactgtatctaccatatgctctaatgtttttggtccagctatttgaccatcttttgttatttgtccgagtatgaatagtattatattgtgttgctttgtgaatgtgattaattcgtgagtacacatacgtatctgtactactgttccaggtgatgatgatatcctagtatcatatatagtttgtattgaatcaataacaacgcatttaaaatctttgttttttttaagggaaaagataatatctgataatgatgaagtagataataattgaatgttggactgggtgatttgtaatcgatctgctctaattttgatctgatctatggattcttcacctgatacataaagacatgtggaaaaatgtttatctaagattgccgttaattgtaataaaagtgttgattttcctacaccaggttctcctcctacaagggtgctactccctaatactataccacctccaaatactctatctaattcacttattttagtaataaagcgtgatggagctagtgtatttttgtcagataatgaactcagttttacttcagaactatgttgtgtattgattaaatgttctgtgcctgtttcctcaataatactatcccagttaccacatgcattgcatttaccagtccacctatgtgtttgatttccgcaaacttggcagacatagaaggtttttgtagacatacctatagattataaagttgtgttgtccttgacattgatcttaacaaataaaaagtatattcgctactgtaagttttttttatatgattttatgcttttggttaggatatataggaagagtagatatttcattattaggttaaattatcttattgtattaacagtttgtggacagtgtttttgatgtacatcaacaaaagtataattttaattaatacctgtgaaatattaaaatagcacttatatagtatacattaaagcaatttccaaaatagttaagtaaatatcaatgcatgaggaaaaaacaaagatttttactaaaactgtagcataatttattaaatggttttaatttagattaattgagatatacatatactttttttgtattaagtatattttaggaaaatgcggatattacttagaggtcatattttattgacgtgaaaagtatgtagtgttattaactgataaagtgtcatgaagggaattaattatataatgaaaaaggaagcacaacatatacaaaatttaatagatagagagttggattcctctaaaccaattgatgaaggtcataaaattactggttatacagtgagttttatagcgtttttatgggcttgttttcaattatttatagcatctccattacctttttggttagtaaattgtgggttggagtgggcagtacttcctgatattaaatctcgggctattcatttagcatttgccttttccttattatttttgtttttgccaatatctaagaattctaatcgaggatttagagcattagattggatttcttcaatattatcatgtgtaacggtattatatattgttgcgttttatgaagatctatcatttaggattgcaatgcctaatgatattgatttgattgtagcattttttggacttttgtttctattagaaggagcaaggagagcgataggaattcctatatctattattgctatagcatttttagtgtatgcttatctaggaaaatatatgccagatattattgcacataaaggacataatttttctgctatagcatctcatgagtggttatcttctgaaggagtatttggtgtagcacttgctgtgtcatctaactttgtatttttatatgttttgtttggcgcttttctggataaagcaggagctggaaatttttttattaaactttcttttgctttacttggtagatttgttggtggtccagctaaggctgcagttattgcctctggttttatgggtatgatgtctggctcttcagttgctaataccattactataggttcttttacaattcctttaatgaaaaaaatgggtcttagtcctgaaaaggcagctgcgatagaagtatcagctggtgttaatggacaaattatgcctccagttatgggtgcagcagcatttttaatgtctgaattcttatctattccttatgctactattgtaaagtatgcttttgttcctgcagttatggtatatgttactttgctttatattgtacacttagaagcatgtaagttagatatgcgtcctgtacttgacctaactaaagcaagatctatttatttaagtgttttaagatttcttatagctattgcctgtttggttgttttttcgtgtatcgtttatgtactaatagaagggattagtatatatggattctatgtacctggtattaaagcaatatttttagataaaagtatatattgtatatcattggttatagtgtctgtgtatgttgccatattattttatcagttcaagggtaagagaagtaatattgaaggtgttgaagaggaaaagaaatatccaaaattatcagaaacttttaagtatggtattcattattttattccaatttttattttaatatggtgcttaattgttgagaaattatcttctgctttagcttgtttttggacgaatttatttttgatatttatcttgcttactagagatgtaatatatactttgtttaataagcaattatcaagcttatgttctgtattttgtggaagtgttaagcaagtatatgaagctatggtcatggcttctaaaaatatgatcgctattgcagtggcaactagtgcagcagggataatagtaggagcggtatcattaactggatttggtttatcaattagtggcttacttgattctatagctcatggtagtttgttccttactttgttagtgacagcagtaatatgtatagtattaggtatgggcatgcctgcaacaggatgctatattatagtatctacgcttatggctccaattttaacttctgttatacataagactggtttgtatgttcctcagatagctattcatttatttgtgttttatttcggaattatggcagatgtaactcctcccgtagggatagcttcttatgctgcagctgctattgcgaaaggtaatgcatttaaaacaggagtacaatctttcttgtacaatataagaacaatgattgttccttttttgtttatatttaataatgagctcattttatatgatattacaaatatctggaataatatatttgtaatttttgtctctttggttggtatattaagtatttctgcagcaatgcaagggtactttattaggaaaaataagttatacgagtctattatgcttttaatgttggggataatactgattatgcctaattatattgctaaattatttgtatctccttatgatactgtaccattttctaaattaaatgataccttagtagtttttaaagatagttctgtgagacttactgtagaagcgagtaatcaacctgataaagtaaggaaagaagtaattattccattaaaagataagatagaagattctgaatatcgcggtacattatttgatttattaagccgaaatgttggtattactgttgatctcaataacacgtctgatggctatctaagagttaaagagatagcaagttggagttatatagaaccatctgatatggatgatagttattccattgtagaattagcattatcgttaaaaaagcattatcatgttacttatgtttacttgatagctgttatattactaactacagtgatctttttacaaactagaaagagtaattttataagacaggaataggtttatgctagatatagcagtaattgggattatattattgtcagttgtaattggtctttttaggggttttattaaggaaatatttggattatgtggtatctgtgtatcaatattgttgactatgcgatatcgaagttatttttctggcttgtatggtcaatatgttgtttctgacattatatcggagattttatctacaattactgtttttattttgatcactgttgctattattgttgttaatgggtggattatgcaccttttatcttcagcaagatgtactgtgattgatagatttggtggattgttaatagggttcataaaaggagtagttttttcttattttctattttttatcatagaaacctcttgttatgcattattacctgctgcagagaaagaagatgatgaagtattgcctacttggtttgtgaattcatattattataatatattttatatctttaatacttatgtagatgaaataatgccagaatctactcatgagaagattcaagaagtagaatctgcagtgcaggatattcttgagaaaaaatatactgctagtaatgtaaaaaagaagaactacaaacgtgtagaaagggatatgactaagaaaatataagcttattagctgatagcattatctagtgtatgtcaaataataaaaacatttgattagaaaaataattaacttgattataatgtaatattttatataatggcgtagttagtttttgttaaggagaagacgtgcctttatatgaatttacttttatagcacaacaaggtttgactcagtatgagttagaagggttggttaaagggttatcgtccttgttaacaaaaaatggtgctgagcttcttaagtatgagtattgggggcttttagattttgcttataccatagataagatgaataaagggcattattgcatgatatatataaaagcaactcctagcagcatggatgagtttaagcgtaaagtcaggttaaatgaagatattttacgttttctgtgtcttaagaaagataagttaccaaaaggtgattctttgatgatacaagcaagtcaagtatagttggatatttattatgttgaaaaaaaataagaaagcaaattctaataattcgggagcgactgcttattctccattagcttatctcaaaagaccgtactttaagaggtctaaggcttgtccgttagaacaatgtcctaatgaagatatagattataaaaataaaggtctgctatctaaatttacctcagaatatgggcgcatattacctagtaggattacttctgtttcatctaggaaacaaaggttattgtctactgctgtaaaaagagctcgttacttagctttattgccttattgttgatattttttataggttaatatgttatcagttattctaaaagaaagtgttagaaatcttggtaaagcagggatggttcttaaagttaagccagggtatgctaggtacttgctgacacagaaaaaagcagttagagcaactaaggagaatttaaaaagcttagaggagcagtacttatttattgaaaaagaaaatttagaaaagttagaggcagctaaggttttaaaagcatccttagaagatgagttcttaattataactaggcaagcagctgatgatgggaaactttttggttctgtaaccccaaagtgtatatctaagttgttatctgataaggggtataatatacattaccgtaatatatttttttactctgtaattaaatacattggtgaatatgtagttaatttagaattacatcctgatttagttcttcctattacactttatgtagttaagaatgatttaggagctatgcaagcacaaaagttgcatgcagaaaagaaaagaaagatagaagaagggaaagttgaaaaaggaagttgtactgagggtgaaagtttagaacttggtagcgttgataatgatataaatagcggtaatgtagacagtaatgagagtgagaaacaggatagcgtttctgaataacactttaagttgtatctaattgtaatagcgctgttaagagttttttataatttattacggggttctttctatggttgggtatatcttagatgatgatttacaggaagttgatgctgaggtttttaattgtatttctggagagttaaatcgacaaaattctggactacagttaatagcgtcagaaaattttgtgagtaaggcagtattgcaagctcagggttctatatttacaaataagtatgctgaaggttatccaggaaaaagatattattgtggatgtcattttgcagatattgtagaaaatttggcaatagaacgtttatgtcgattgtttggatgtaaatttgcaaatgttcaaccgcattctggttcacaagctaatcaaggagtatttgctgcattgttaaagccaggtgacactgtcattggtatgtcacttgattgtggtggtcatttaactcatggttctgctcctagtatttctggaaagtggtttaatgctgtgcagtatcaagttgatcgtgatactggtttaatagatatggatgaaatagagaagttagctgttgaacataatccatcattaattattgctggttcatcttcttatcctcgtgtaatagattttaaaaggtttagggaaatagctgataaagtgggagcatatcttctagctgatatagcgcattatgctgggttaattgctgctggagaatttccttcgcctgttgaatatgctcatgttattacgtctactactcacaagacattgcgtggccctaggggagcagtgataatgactaattatgaagatatccataagaaaattcaatcttctatttttcctggtatgcagggtggtccgttaatgcatgttattgctgctaaagctgtagcatttgcagaagcattgaaacctgagtttaaagattatgcgaaacaaataataaaaaattctaaggctttgggtgaagtatttaaagaaagagggcttgatcttgtgacaggtggtacagattctcatatggttgttcttgatttacgttcaaaaagtgttacaggtaaagatgcagttcttgctttagaaaaactaggaattatttgtaataaaaatgctattccttttgatccagaaaagccttttgtaacttctggtttacgttttggtagtgctgctgagacttccagagggttacaagaatcagaatttagggaaattggcagtatggtttgtgatgttattgatagtttaaaagctagtgatagtgttagattatctgttgaaagagatataataaaaagagttaaggaattaacttctaattttatttagttaagtcaatgtaaaatgatatttaaaaatgtaaataatttagtttttatttacatacttttttaaatgtgattaacatataattagctatatttttgatttgctagaaaggttcatgttatataagtaacgttgctataagctgaatggtagggggcatgtcgcattctttatgtatatctgattttcaaaatttatcttgtaatctcttaaatactttaactgcaatggtagataaagtagatgttgatggagtgttggagtgtgaaaattatgacggattagtaaaaatatccgatagtaaaggtaatgtgtatgttattaacaaacatgatccttctatgcaaatttggattgcttcacctattagtggatcagtaagatttaattatgatagatgctcgggtacgtggataagtaataaaaatgatgagttgtttgatttgtttaaatctgaaatgaaagtattgtttaatattgtgatataaaaatgaaagtgttatttcaatttgtaagacctcatttattatactttatatttgcgtatttagttgtagctgtttcttctatatcaattttagcatttttttatgagttacgtaatttagtagacttgtgtattgcaacttctgatgttgcagccataaataatgccttgttgtttttgtttagtatagttttaatagtagggttatcatcctttttgcggttatggcttactggttatgtgagtgagaaagttattcttgatattagaataaaattgtataataaaattatacatttttctcccaggttttttgaaaataatagtatatcaagtttaattacacgattaatggcagatacagcaacactgcaagttattttaagtactagtatgtcgacaatacttaggaatacaacaactttgcttggtagtgttgtgatgttagtacataccaatgttaagttgactatgtatactgtgataattactcctattattctgataatcttagctttcttcggtaaaaaagtgaaggtattattacgtaaggtacgcgtaaatctggataatgtaacttcttttgttgaggaaacatgtcgtggaatatatgttatccaatctttttcgagagaagatataacaaagcaaaagttttcaaatttgcttgctaatacactaagtatgacaaatagatatattgttttacgtgcattactagttacattagttataacgcttacaatgctttctataggatttgtcctatcttttggaataagagaagtattgaatggtaatatgactgttggttctcttttttcttttatattttatgcaataatagctgctagttcaatgaataatatgggagataattttaatgatatacagaaagctgtgaaaatttcagaagatatttctaaaatgttgttgatgcagacagatattattgaagtaaaagatccatataaaattcaggaagtacaagataaaatttcaataaacaatgtcactttttattaccctagtaaacctgataatcctgcattaaaaaatgtatcatttactattgagaaaggtcaagttgttgctttggttggaccatctggtagtggtaagagtacaatagtgaatatattgttacgtttttatgatgtgaatataggtaatattactattgatggtatggatataaagaaattatccttaatgaatttacgttctctatttagcattattcctcaaagtcatataatgttttccggaacaatatgggataatataacttatggggtaactaatgctgaatacgaagatgtaagaaatgcagcaaaaatagcttgtattcttgattttgtagaaagtttaccagataaatttgattctttagttggagaaagggggttgtgtttatctgaaggacaaaaacaaagaattgctatagcaagagctgttttaaaggattcaggtgtccttgtattagatgaagcaacatcatctttggattcgaaaaatgaacaactcatacatgatgctttagataatttaaggaataatagaacaatacttgttatagcccataggttgtcaactattcttaaggcagataagataattgtttttaataatggatgtattgatgatataggtactcataagtcattaatgcagaagccaaatggtttgtatgcgaaattagcaaaattgcagttatcaaatgatagtttttcagaggatatttaattagtaaagatgacttctgttggggggtgatattctaaaaccttctgatgaataaggctgttatggtttgtagaaattatattttaatttactatgcttagacttataaagtttgtttttagtggtgtatatgtgctattggtattgtaatctagtggatgcatttagaatgagtagtatgaaaaaaagtatattttttcattagttttctgtgctataaatttgtaggagttgtttttgttaaaatggtaggaattgtttttacaaagtttatatgtagttaatttatagatatattttcaaaatgtttgtaaaaaaggaagcatagaagtgaaagaaatatactctattgctttacctgagggtagatatattttaatcttaggtgtaagaatgcttttgcaagataaaagttggattattattgctggatagtattagctttattttatatatgaaatataaggtctaaaagtaatagtattgtaaactggagtgaaatctatagatgtctgtaaaatatgtataagaatttttatacgatgaaggaactacttattaagacatttttagcttcatagatgatgttttttggagaatgttatctgtccataattgttaggtgtagtggcaataggtacagtgcgactagcaatttacaattattaattttctagattttgtaaagattttagtcattttttactaacaaatgttaatactgtctgtaattagttttttaataagattgcaagttatattgtgaagttatttaacataggaattatattgactcattgtgttattgtggtagcctaattatatttattatttaagtattatttattgtaatgtctggttctgcatatgatattataaatcatgaatatgatgttgtaatagtaggagctggaggagcaggtttaagagcaacttttggtatgactaatgttggtttatcagttgcatgtatatctaaagtttttcctacacgaagtcatacagtagcagctcaaggtggtattagtgctgcgttaggtaatgtttctgaagatgactggagatggcatatgtttgatacggtcaaaggttcagattggcttggagaccaagatgctattgaatatatgtgtaaaaatgcggcagaagctgtaattgagcttgaacgttatggagttcctttttctcgtactagtgatggtaaaatatatcagcgtccttttggtggtatgactacagagtttggtaaaggtaagccagcagtacgtacgtgtgctgcatctgataaaacaggtcatgcaatacttcacacattgtatcagcaatctttaaagtataatgctaagttttttgtagagtattttgctattgatttaataatggatgaagaaggccagtgtaagggtgtattagcatggtctttgtgtgatggtacgttacatagatttcgtgctcatattgttgttcttgctacaggtggttatggaaggatatatttttctgctactagtgcacacacttgtactggtgatgggggaggtatggtatcccgtattaatttgccgctggaagatatggaatttgtacaatttcacccgactggaatatatggtgctggatgtttgataacagaaggttgcagaggggaaggtggatatttaattaattctgagggagaaagatttatggagcgctatgctccaaaagctaaagatttggcatctcgtgatgttgttagtagagcaatgactttagagattagagaaggtcgtggtgttggtccaaaaaaagatcatgtatatttgtctatatctcatttaggtgcaaaagttatcagtgaaagattgccaggtattcgtgagactgcacgtacttttgctggagtagatgttataaaggagccaataccagttttaccaactgttcattacaatatggggggtatccctacaaattatcatggtgaagttgtaactttaagcaataatacagagcagataatacctgggctttttgctataggagaagcagcgtgtgtatctgtacatggtgctaaccgtttagggtctaattcattgcttgatttagtagtttttggaagagctgcagcaattagagcaaaagagttaatcaaacccggaatgttacatgctccagtgcagaagtcatcagaagagtggataattgataggtttgatgcgttaaggttttcaaaaggaagtttacgtgtatcagaaatacgtagtaacatgcaaaatgtaatgcaaaatcatgcagctgttttccgtacagaagaagtgcttgaagaaggcaagcaaaagataagaagtgttgctgagtctctgtctgaaattgcggttaaagatagaagtatgatatggaatagtgatttggttgaagcattagagttaactaatatgatgccgcaagcagtcgtaacaatggaatgtgctgcaaatcgtcaagaaagtagaggggctcatgcacgtgaagatttccctgatcgtgatgatgagaattggatgaaacatagcttagcatggtataattctacagattgttctgtacatataaagtataaagatgttgctaaagcaactttaacagatgatgttcagtattttcctccacaaaaaagagtatattaatactatctatatagttatatggtggttatttaaaaggtttgactatggttcaattttttttacctaagaattctaaagttaataagaacggtaaggttcatcatgctcgtaaaggggcaaaaaatgtaaaatgttttaaaatatatagatggtctccagatgatgatgaaaatccaaggattgatacattctttatagatcttgatgaatgtggacaaatggtgcttgatgctttaataaagatcaaaaatgaagttgattctacattaacattcagaagatcatgtagagaaggtatatgtggttcatgtgcgatgaacattgatggtactaacactttagcttgtacaaaagcaatatcagatattaaatcagatgtaaatatttatcctttaccacatatgcatgtgataaaagatttagtacctgatttaagtaatttttataaacaatatgaatcagttactccgtggatacaagctgaagaacctaatcataataaagaaaggttacaaacaatagaagatagaagcaagttagatggaatatatgactgtatattgtgtgcatgttgtagtactagttgtcctagttattggtggaattcagataaatatttagggccagcagctttattgcaagcttatagatggcttattgatagtagggatgaagcatcagatagtaggttagatgtacttgatgatgcatttaaattgtatcgttgtcatactattatgaactgtactaaaacttgtcctaaagggttaaatccggcaaaagcaattgcacatataaaacaaatgatggtaagaagataaatgccgttaaagttatatttcaatggttaatcaattcatagtgaaataaagttattggtatatgtggtttgcacaattgtatttttgacatgtattgtgagaagggaaagtgtaaaagtatatttgattctacattatgagtccatcaattcactgtattaatggaaatgtttttaggatttacagtacagttgagaggaattttattgagattgaaataatttttgctgttattcaagagattttgagttaatctatagtgtgaaatagtttgaaattttgtagtatgcttttttcccatgtgaatagttaatgagaattttaaaagcttgatctaatgtagacaattgctagtattgagtatgagtaattaaaatgtagggaattatggaatcagcagttacaaaacgtatagttgtccctgagttggaagaaatcctttataaggaatataaagttttagacaaaggatttgttaggttgattgattatatgggatctgatgaatctatagtgcaggctgctaggatatcttatggcaggggtactaagagtgtcagtcaagatgctgcattgattaattatttgatgcgacattcacatactactccatttgagatgtgtgaaattaagtttcatattaagttacctatatttgttgcaaggcagtgggtacgtcatcgtactgcaaatgtaaatgaatattctgcaaggtattctgtgttagatcatgaattctatattccggagcatagtcaagtggcaatgcagtctgaagataatgctcagggtagggggaataatttatctgatgaggatgcaaagtatgttgctgatcttttaacacgtgattctgatatggtatatgaaacttataataaatttttggagaaaggtgtttctagagagatagcacgtgttaaccttactttgaattattatactgaatggtattggaaaatagatttacataatttattacacttcttgaaattaaggtctgagatgaatgctcaatatgaaattagagtatatgcagaaactatgttggatattgtaaaaaaatgggttccattaacttatgcagcttttgttgagtattgtttaaaatcgcaaaacttttcaagaagtgcattagatgttgtaaagaagttaattgttggagaaaaagtagttcaagaagatactaatattggaaaaagagagtggagggaactgatggctattttaaagcctgaatgagtttttttggattagtatcagtaaattcttagttattatgtaaacgtctgttaaggtttaatactttatagttttcaagtacttgagatttttagtttataggcctgtatattaatttatagaatatatatgattagtattttttactgatcaggttttatatattttataaactcaggtattttttcataaatcatagttagaggtaaaatatattttcaaatgttggttttaaagatttagttctatttaattatctacgataattttatatgagatgttatattagcaatgtgtttattaattaaggattccattttagtgtatgaaaattttaaaaagaaatattttaattcttattattgccgttattgttttatctgatatatcttcagatatatatttacctggactaccgaaaattagtgattttttttctgtagattatgctatcgcacagctaacaattagcttgaatttagctggaatatctatttcagggttattatatggtccactgtctgattattatggacgtagacctattatgttgttaggtgtgggaatatttacattagcaagtgtagcatgttgttttgctagcaatattactgtgttaattattatgcgttttattcagggatttggtgcaggtgtagctggagttgttggctatgctattatcaaagatatgtactctggaagtgactgtgctaaaaatatttctatagtaaatatggcagtagcattttctccagtattgggaccgattttaggtagtgccattatagcacatggttatcattggaatatgctgtttatagcaatatcaataatggcaataatagttctaatatgtctatttgtgtttttgaaagagactattgttcttgagaaaattaatagtaatatctcttgcttgtcaattatgcggaagtataaagagcttgttttaaatattcgattttgtggttttgctttaattcaaagttttactattatgtggatttggtcatgtatagctaatttaccatttatttttgtaaaagatatgggtgtacctgttggttattatggctattttgtggctattaatgtagctgcatatattgttggtgcaatgctaaatcaaagatttgttgagagatttggaataaataatatgttacttttaggattaattttaactactttatcagatgtaagtgtcctaatactctatcaaatagttgaaattactcctttattggcagaaattatgtggcttccatctggtatgggtattgcttttattcttggaaataatatgactgctgcgttttctgaaattagggagccaggtataggttctgcttttattctgtttttgcaaacaatttttggtgcacttggtatttatattttaggatgtttttatgatggtactctgattccagtgatactatttccaataatttgttctacaatttgcattgtgatatatattcttttaaggaaagataaaaataataaatctgaattcattagtgcatgattattgtactgtttaacaataggaagtaaaattgtgattctaagtgttttttatttataaaataggaaaaaatggtagatttgtgtgaatatatgtttagcttattttatggttttaatagtaaaaagtaaggttgtatactaataaatatttagtttttttacacttaaaaaaggtttataaaagtaatgtttaattagtttgttcttaaatatattcttgttctctaagatgagagattgctttttctgtaattactctaccacgtggtgtacgttgtatgaaatttatttttatcagatatggttctatagtttcttctatattacctgtatcttctgataatccggaagatatagtatctatgccagttgggttgttagagtcgtatatgaatttgagatattgaatatcctgtctatctaatcctagtttatcaatacctaaacgtagtagtgctttatcagcaaatgtatctgtgatgattttgttatgttctgttacttccataaagtctcgtattctgcgtaataatctgagcgcaattctaggtgtaccacgagatcttaaagaaatttcttgtgctccactattagaaatatttgtcttaataacttttgcagcacgttgtattacttttgtaagttcttcagttgagtagaattctagatgtattggaatgccaaagcgatcacgtaatggatttgataataacccaattcgtgttgtcgctccaactaatgtaaatggcggtaaatctactcttaatgtgcgtgctccacatccttctcctactattatgtctagacaaaaatcttccattgcggaatataatatttcttctatattgcgatttaagcgatgtatttcatctataaataatatgtcttttgcctgaagattagtaagtattgcagctaaatctcctgctttacttagtaatggtccagctgttgatcgaaaatttacttttaattctttagctattatgtgtgctagtgttgtttttcctagtcctggtggtccatataataatacatgatccattggttctttgcgtgtataagctgcatttatgaaaattttaagattattaactacactgctttgtcctatgaaatcatctaataggttaggtctcattgagacattttgttggtcttctaaacattcggtactttgcaatatatttttcataaagtgctctttattatttttctatatgactttttctcttaaagtgtaagagtataatactctattatagataaatttgtactttataattaaaagagtaataactattatgtttttcatgctgtaaagacataggaaatcagtatcagcatatgcataatgcatgagtgtttaatacatttatatattaagaaatgtaatttttctaaataattatgatatctttatactttttgtatacagctaaagcatcaaaaatttctgggtttaatatgatgattattccacttgaaagtaagacattgaagtgatattaaacgatatttgctacttttattattgaatatggaaaaatactattatggatatatctttaaactaatggatagaaattagaatggtgtattgcttactgtatttaactctataatagctatagtaatcaagtcaggtaataattgatttatgttatagtaaagtgtttttttgatgtttctagcgtttttgtaatctgagatgattataaaaaaaaatcccagctatatttatatgtataggaatttttatatcgtttattttttgtgatttatgtctattgagaaagtttttgcaatgcttttcgtataatttcttgtatgctgtcatcaggaaaattggcttttatttcttgtattgcattgaaagcttttagtttgtcataccctaaacttataagagcagctaacgaatcatcttcttttattatgagggtttcttctattggcattttactaatcttatattgaagttcagttgtaatacgtcctgcaagtttttctcctataccatttcccctaaatgcgtttttgttgttacttactactgcagaaaagatttgttctggtgatagtttacttaatattgagatagctgttttatggttaataccatttattgtaactagcattctcatgtaatcttgttcttgtttatctaagaatccatacaactgagttagattatctctgtttacataggtttctatgtaaagtttaatgttatttccagttttgcaactttgtaatactttatgtgaaacgtaaattatatatccaacgtttcctacgtttaatatgatgtagttattgtatatttcttctataatacctgtaagactacctatcaacgttttcctcagaaaatattatttaacaagataagtttagaattgattctacgtaggttgattagtgtgtgtgatctaagtattaacaatatacagaatagcactccaagtgtagtaaacattgtaaaaagaggtattagcattgatatatcaatggtagttccatttgtacgtagtatacttgcaggctgatgtaatgttgtccatatatttacagaaaatttgattactggaatgttgattgcactgaatatagcaaatattgaagcagctttcatagatctggcttcattatcaaagaagttccataaggatatatatcctaaataaagaaaaagcaatactaacattgatgttagacgtgcatcccatacccaccatgttccccaagtacatttaccccatatgctaccagtaattaaacatatagatgtaaacgttagcccaagtggagcaatagcatgtgatataattgctgaaatcatatttcgccatattagtgctataaagctaaaaactgccattagtgtatatgagccaagtgaaatccatgctgctggtacgtgtagatacataatacgaacaagttctccttgcatataatctgcaggagatgaaatgaatatcatgtataaactgcatactaaaagaacaaagaataagaatactgtatatggtaaaaccgatcttgtgtaacggatgaacttactcataagtatatagtcattacatgatcatttaacgtaccataaattacagcattaggcaatctatatgatagaagtgagtcatgggatgtattgtataatataagttattggtatttttatattttagtatagttttttgtttgtaaggaatattaattggtaagaagagtttattatatatcaaatatatattgtgtttttgtgtactattatagtgcttatcagtaatatgtttttttattgtattgaaaaatttgctataggttttatataattgctgaagtcttacaaatgattttattttataaaattattgctacataagtgtggaaagtgacattgtttaatatttatataatggagttttattaagttgagttatatacaatattataattattattttttttaggaaatgtaaggtgaatgatagtttaaaaagtaggggaataatgttagttatatcatctccttctggaggtggtaaaactacaatatctcatttgttaattaatgaattacaaaatgatcttgttaggtcaatttctgttactactcgtgaacctagagatggtgaaatcaatggtaaagattatttttttgtaactgaacctgagtttatcaatttgtgtaatacaaatcagatgctagagtatgcaaaagtttttgggaattactatggtataccccgtaagtttgttaccgataatattgctaatggtgttagtgtattgtttagtattgattggcaaggggcgtttaaattaattgatattatgcgagaacatgtggtgagtatattcatattacctccatctatggaagagttgcaaaggcgactatataatcgtagtggagaaagcgatgtaataaataaaagattaggagaagctgcttttgaaattagtcattgttatcgttatgactatgttattgttaaccatgatattgaacaaagtgtttatcagattaaatgtatttttacttcagaaaaattgaaaacgcaacgtagggtatctctaaaacaatttattgataattgtatcagatgattgtaactcatcataaatttataacctaacgttattatttattttattaagtagatgataaaataaaaaatgttatttactaaatcctaattatttgttctgtttgtagtgtttttttagataaaggaaaacatgatttctgaaattttgaacttgattgatatttgtgtgtaaatcaggaacattttgtatgataagaggtgaatgatagtaaatgtaaaatggcatttatgagagtaaaactgcattaagttgaaaatggatatgacaaaaatagtttgaaaagttatgtaaattattattgtgtctgtatgtagtaaatcaggaacattttgtatgataataagtaaatgatagtaaatgtaaaatggcatttatgagagtaaaactgcattaagttgaaaatggatatgaagaaaatagtttgaaaagttatataaattattgttgcagttggtattagttattagtgtttgttgaagttttatgtgaaatgtactagtctgtaaatgataatcacaatttttggactctaatggaagagaatattataaatggaaaagtcatcgctgaggatattactagtacacttgctgtatgtattaatgatttaaaagtacagcataatgtaacaccatgtttgatagttatacttgttggtgatgatcctgcaagtcatttgtatgtgcgcaataaacagcgtaaagcagagatgttgggactaagatctgaaactatgttattgccaagcacaacatcagaaagcagtttaattgatacaatacgtaggttaaataatgatgatagtgttcatggaattttagtgcagcttcctgtaccaaagcatattgataagaatttaataattaatactattgatccaaggaaggatgttgatggattccataatgaaaatgttggaaggttgtttactggacaaaagaaagattgtctaataccttgtactcctagaggatgtctttatttgattaaaactgtaactcgtaatttatctggaagtgatgctgtagttataggaaggtcaaatatagtaggtaaacctatggcttgtttattgttgggggaaaattgtactgttacaacagttcactcagctactcgtaacttacctgattattgttctaaagctgatgttttggtagctgctgttggtatacctcattttgttaagtcttcttggattaaacctggagcaattgttatagatgttggtattaatgctatagaggaaggtggagttaaaaagtttgtaggagatgttgatttttctgaagctagaaatatagcttcagctattactccggttcctggtggtgtaggacctatgaccatagcatttttaatggttaatactgtaatagcagcatgtaatcaagctggtattgagaattttgttgaaaagtatttagatttgtaattctttaattgcagtaaattcatttatggtttataactaaataataagggcggttagctcagttggtagagcgtctcgtttacaccgagagggtcagcagttcgagtctgttatcgcccactccattcttttttctttgttttatttaagtcttgtgtagaggtatgtagtactttctcttattctataatggtaagtatattagaaattaatatcaaaaagttgaaacatattatttagtttcttatgtttttgtatgtagagataactatgactgtactttttatgggaagttttatatgaaagacttataggaatttacttaatatagtaagttaaatactgtgaaggtattttaaaaatttttatgaaaagaaagataatgattttgaacaaatttgcctataaaacttttataaagaggtaagatcttattccagttatttttatgtgaacgtgtttctaacgtttaactattgataatgagaattcttatgtattgaattagtatgtattcttataagttagtaaagaggtgagtgttatctgttagttatgtattaataaaatgattatttaatatgtacttattgagaatacagcatatagttaatgctttcattttcctattttacctgtatactctgctctactgcttctttaatgtacttaaatataatatttaatgaagtatcatctgataagttatggttagctgactttattaagtgtaagttgacattatctgattttattttctctgctacagttatggaagtttgatatggaactgtgtcatcattcattccatgaataagggtgatagggcaagtaatgttgatagattcttgatttaataataagtgcttacgtccatcttctattaagttacgagttattacataagaatacatgttattgctgttttgagatagagtgatttgtccatatttatatagttcatctttttgttgtgtatttaatttttgaaaaattaaagattcagtaaagtcgggggcaccagctagactgattaagtgagatactttgtcttgatgagatattgctactaataacataagccatgctcccatactggaccctatgataattttgggtctattagtaggagttaattgtgttatgatctctatgcagtttttgtaccaatcactaatgttgtagtcagtaaattgaccatctgattgtccatgccctaagtaatcaaataaaattaaccctaagttatgtgatttgcagtagtcgtataaagcagttgctttagtaccttgcatattggaattaaatccaccgaaaaatataatggatgctttatttcctagcaattgcctataagtaatgtgtaaaccttgtggattagataatactaacttgtaatggtcagacatattttacctgaagttattccaaagatttcaagtatgcaattaagtctgctacgtcttggggctttgaaataccagcaaatgccatgcgtgtacctttaatataagcttgaggttttgttaaaaactgaaatagatcttgatattcccatgtgccgcccttgcttagcattgctttcgagtaattgaagctgtcccctagatgtgcttttttgttgcctacaatgtgccataaatttggtcctactctatttgctcctcctttttcaaaagtatgacaagatatgcacttttttgtgagatctttgccttttgcaatattagcttgtgctattagagattcaatgtcgatttgttcttcagtattattgacttctgttggaatatgttcttctatatttattttataaccttttgtctgttcagcatgtggatcgggatcgtataataaatttaccacattgctaataaacagtactataaatgatgcaaataaaatggctgtaaatatcttgtttaagtggaatccgtccatggctattgcattcctagattataagaaatatactgtacacttttagagtaatataatcattaactgtagtcaataaataacattatttctttattaatatagatgataatcttaatctataagcggcatatgcttaatgtgcagtactttaattactatgctatatcatattaaaattttattaagttttatagttaacttaaattaagtgatagctttataatataaataataactctagctgtgtagtgacgtgaaattacatgtatatgacttttatttaaaaaatatcaaaaatcatatccgggaaaaagaatagtaatagtgtgcatactgcggttgtaactatagatataagcattggtactggggcttctgcatacttaaaattataagatgtagaaaatgcattatatataatagggagaaaatatattgtatttaatacagtgcttgatactaatactaatgctactgtgatattattctgacttaatgcttctgagagaataaagaactttccccaaaatgtaggagcaggaggtatacctatcattgcaatggctccaatagaaaatgcaaccatagtaataggcattgatatacctattccatgaagttcatataagtattttttccctgtttttgtgtatattgctcctgcagcaaaaaataatgtgatttttgcaaaagcatgcgatatcatttggaatatagagaccttaattgcatactctgtatataatgatgctgccattactatgtatgagagttgtgatattgttgaatatgcaagtaacttttttaggttagtttgtttaattgctgttaaggatgctaatataattgtgattcctgaaatatacataattatattattgtgttcttggacaagtgtgtttaacttttctaatcctataatgtataataggattttgattatggtaaatactccggattttacgactgctacagcatgtaataatgcgctaactggagtaggggctaccatggcttgtggtaaccataaatgtgtaggcattaatgcggcttttccaattccataaattaatagtagtaataaccccatgagtaaactgctggagatatttgttggtaatataccatttgtggtaaaatctagtgtgccacttacattatatattattaaaattgctggtaaaaataacagcattgaagttcctaataatattcctatatagtatctgccagaaatttgtgactgagtgttgatatggtatgtaatgagtgggtatgtacttatggtcaataattcataaaatataaatagtgtgagtagatttgctgaaaatgctatacccattgtacatccaatgctcattgcaaaacatgcataaaatatgggttgtttgctgttgtttgtatcattttttttcatgtaactgatactatagatggtagtgattacccataaaaatgaagctaacaagccaaatattatgcttaatgtttcagtttttaatgcaatttgtatctgaggatcaatgaattcatataattttatacataactctgaattattattcatgagctgcagtttatatgtttcaaatactgagtagaataaggtacatgaggaaaatatacttataacttcttgtgcatatttagttttctttaatattaatattaaaaaagcagatgtaaatggtagtaaaactatagatagtaaagaaaatcctgatgttaaatccttaagaaaatgcattgattctattattgctgtatttagactatagataacaataaagctttttaaagtaaagtatcttatatagtattttctttcaatatcaattttaatctcggaatctcatcgaaaacattttgtgtgtagtaaatcatgtatgtatacgaaaattagttataaattataaataaatttagttacttttataattcttgaagctatataagtttatctatatttttatgtagtttgtttagttgttcctatattgtttgttacatagcaaaattttttacaaattcattaaagtatatgtagaataacacttctgccattgcatgatctgctgaaattaggtgtccatcgatttctactgtgtctattatgaagtttttatctgcatgtatgcaatcagaccacgggcctcctaattgtgcaattatattattaatagaagatttaacttttttataatctattgcaacgttgtaccatttttttaaattgtggggtttaggtaatttgccaccaattcctacacgtgatactgggtcaattgtacataataaatctatggtatttgttttaagtgtttttatgactttgtatccagtgtctcctccccaactatgtcccacaaggcaaattttttgctgtgcttcgtaccaggcttttattattgggattattgctgatgatccccaagttgcatatgctatatcttggtgattatggttctgtgtgtaatatttggcatataagtgtaatacaagtcttgttgtatcatctaatgctcccccaataaatattactaaaggttttgtgcctggagtaattttacttcttaaaatttcttttgaatttctagggattgcaatgccatctgtactatatcctcttcctgttcctactgctggaatatatggtggtatgattttatcggcaacaaacatgagcatttttatttaccttgaatgataacatgtgtcaacgttactacagtgaatggttttaggaaatatttagattaaaaagtaaattttgtttgtattacaattaaagcaatgataatagaatgaggattaaaaaaatagttatgtgattttttataattacagtgtcatctataaaatgtaattgtattttaacatatcatggtattgaaagaaaaaggaactttcgtctctggtagaaatacgcacaaaaaagtctcttaattagtaggtatggataaactcatagccatctattattctacactctgttcataatagcagcttgtgcagctattaaccttgctgttggaattctatatggagaacaagaaatataatttagattcagttttgcaaagaattgtatggaatcaaagttcccaccatgttctccgcatataccgattttaatattcggagaagatttcctacccaaatctacagcaattgatattaatttacctactccttcaatatctaaggtttcaaaagggtcttgttttattatttctaaatccttatatatttcaataaagcttgcagaatcatctctagatactcctaaagtagtttgagtaagatcgtttgttccaaaactaaaaaattgagcatgttgagcaattttatctgcaattagagctgctttgggtaactctatcattgtccctattgaatactttggattattaaattgctgtgctacattactaattaattctttaatgataacaagctctttttcattcataactaggggtatcattatttcaggcactattcctgttatgtctgtttcttcttgtagttcttttattgcgagaaagattgccctaacttgcatttcatatatttcagggtatgatatagcaagtctgcatccacgatgtcccagcattggattcttttcagataagtatagaaccttgttccttaatttctctaaagatttaccagttcttactgaaacttcatttattgcattgtcattatctggaagaaattcatgtaatggagggtcgagtaatctaatggtcacttgcttattgattgtagatttgaagatttttttaaaatcttctttctgcataacttcaagtttttctagtgctgctattctctcttcttttgtatcagatacaatcatttcttgtacaatacttattctcttgtcagaaaaaaacatatgttctgtgcgacataatcctattccatcggcttggaagttcatagctatatctgtatcttctggggtatcagcatttgccattactttgagtattcttatttcatctacccactgcattagtttgtaaaaactctcacttaatttaggggtgactgtttttatagttcctagaattacttctccattacatccatttattgtgatgttgtcacccttatgtactttaagtcctgtgttcgtataaaaaaattgctcactcttatctataaatatcccatttgcactacagatacagggcttacccatacccctggctactactgctgcatgagaggtcattccacctcttaatgtgataatacctacagaactgttcattccatttatatcttctggattggtttcttggcgtattagtatagcattttttccgtcttttctgaattgttctgcatcattaggggtaaatgctgcatatccagttgctgcacccggagatgctggtagccctcgtgcgataatattgatatttgtattattttcaagtattggatggaataacttactgaatgatttgtaatcaattcttagtattgcttcttctcttgaaattaatttttcttctaccatgtctactgctattttgacggcagattgaatactgcgttttcctggtctagactgtaaaatccataacttaccgttttctattgtaaattctacatcttgcatttcacggtaatgtagttctagtttttgacataccttttctaaatcactgtaaggttgtggcattaattcctgcattttatttagtggtaatggaatatgagttccagatactacatcttctccttgtgcgtttactaaaaattctccaaagatttctttttctccagttgatggattacgggtaaatacaacgcctgtagcagaattttgactcatattaccaaataccatggattgtacgttaacagctgttcctaaattatccggtatgttgtgtatttttctatatataaccgctcgtttattcatccatgatctgaaaactgcgtctattgaattatatagttgttcatgaacatcttgaggaaaatctttgttagtatgagtactgactatttttttaaattcaattattatttcttttagtatattggggtctgatatttgactatttactgggataccagcttctcttttttttttacatattacttcttcaaataaattactctctatttgtaatactgtatgtgcatacatctgtatgagtctacggtaactatcataagcaaagaattcaccacttttttttgctaaccctattactgtgttatcatttaatcctacatttaatattgtatctagcattcccggcatagagctaacacttcctgatcttactgagaatagaagaggattatcgttatcaccaaattttaaatttacttcattatttaaaaattcaatagcattttctaccaagctgaatatgttatcaggtaacttactgtgttgataataatagttgcatacagctgttgatactgtaaacccaggtggtacatctacaccaatattacacatttctgctagatttgcgcctttaccacctaggatatgacttaatgtaagacttccatcacactttgttttactaaaataatatattaatttttcactcatatgaagagaaccgaaaaaattgtgtttttatgctataatagtcatttatactacattcgctgaatatactataaaacctaattctccatagtgcaactattgtgaaataattaattaagtatgtgtaatgtcaaaataaacagtgatgtttcatgtatatcaataaatgctatattttgtatatagtgtttatgaagagtaacgcgttggtagtgaaggttatgtaaacgtataaagtaacatgtgtgttataaatactgtacttgtggtaatgatataaaataacaagtgtgttctttatcaattatgataatctaagtaggtgtaaggattagtgtgttgtatatggtactataatactagtatgatatgacttgtatgtttttgttgacagagtagtatatcagaggttactcattatctactaccatggtgttaaacatgatatcatgtaaggtttgattcttttgtgaaaataacgcaattaaataccaacatgttgatgttacaaatgttaccatggtaatcaaaaatataatacttactataaaaatattattaatgttcatatttattgcttgtatgctcatcatcaggatagtagggcagagaaattctgataatgatctatcaaatgctagccgaatatcaatttttttatgatcacaacgtatagtgtgtatgtttaatattttttgtccaatagatgcttgtgttttggaggataaaaaatatgtgtaatagtaacaactacttaatacattaaaaataaatggtataattgttatatcgtttgttaacagtacaatggggtagttaagtaatgatagaattacatggtcaataatgcttgccaataccctttttattatatttgcggttttagttttttttatagtcatatatttattaattgacagataaagttacgaatatcataaaaatttttaaaagaaagaatatcctttataatattggtgctaccgtattttatgggtaggcatcccgcttcaattgcactttgtatatctgatatactatctcctatgaaaaatacttctttgcttggttcaatatttatatttgtcaatgctgctaatactggttcaggggatggttttatagttcctgtatctccagagccgatgatagagtcaaaatagtgtgttagatttttatgatgtatttcagatcgtaaacgttcaccattcttattgcttacaattgccatggtgatattattttcttttagtgtatctaataattcaatagctccatcattcagcatgaaattgtctgatttttgtgatttctctagactgttctcatacaagatggttgcttctttccaccttttccctagtaatgtgattagatattttggtattgtagaattgggaatagagtccagatctatatttttatatcccatctgatccaatacttggtaaaaagttgtacgatcgatattaatactggtatcaattagtgtattgtaccaatcgaatattactgctgttggttgtttcatcgtttatttagatttctaaaattaccattcttgtaatacatgtattaagattctatgaaagtcaggattattttcaatgtttaattgaacattaattacaagaatcataattataaatgtagtgtattgcttataaaacaaataatatgcttaccattagtgtagcattttgtaccacctgtcacaaaatcaagctctctttctttaaacacttcacccaaagccttagaattttttattatttgttttgcataatctttaaactcaggcttcaatgcttctgcaaatgctacagctttagcaacaataacatgcattagtggcgttgtgattatgtactactaatggtacactacatcacatggaaatattgtgtaatattaagacttctttgtaatgcttagtgatagtaattttaaatgttccttatctatttctgatggagcactcatgagtaagtcttctccggattgatttaacgggaaacaaattacttctctaatgtttgttgcgtctgctagtaacattaccatacggtctattcctggggcaatccctccatgtggaggtgcaccaaatttgaaagcacgagttagggaattaaatttttggtctaccatttctttggtatacccggctatagaaaatgctttgtacatgatgtcgagtttatggttgcgaatagcaccgcttgagatttctataccgttgcaaactatgtcatattgatatgcaagtatatctagaggattttgattatttaaagcttctaaccctccttgtggcattgaaaaaggattgtggaaaaagttaatagacttttcctttttatcatatttaaaatatgggaagtcaataatccagcaaaatctaaaggtgtctttttcaattagattaagttcttttcctaatagagttcttacttctcctgcaagttctgtagctttatcttctgtttctgatacgaaaaatacactatctccgggttgtaaattacaaatagatttgattctatttaatctttcttcgtctagaaacttagctataggtccttttgcagaaaaatcatcattaaaagtaatatatcctagtccttgtgcccctaatgtttttgcaaattcaatcttattatcaaagaaacttcgcgggttggttgctgtattaggtgctggtattgctcgtactaccattccttgttttatatttgaattaaatatgttaaattgagaatccctaaatatttcagtaacatcctgaattatcaatggatttcgtagatctggtttatctgatccataatgtaacattgcatcatggtatgatattcttggaaattccttatcaatagttttgtttgaaaacttgctaaatacattaagtaatactggttcaatcacattaaatacatcttcttgactaacaaaagacatttcaatgtctaattgataaaattctcctggtgagcggtctgaccttgcatcttcatccctgaaacaaggtgctatttgaaagtatttatcaaatccactaaccattaatatctgtttaaacagttgtggagcttgaggtaaagcataaaactttccatgatgaatgcgacttggcactaaatagtctcttgctccctctggagatgatgatgttaaaataggagtttgtatttcaatgaaacccatggcttccatgcttttccgtagttctgaaatgattttagatcttaaaataatattgttttttactttatcacgtcttaaatccaggaacctatacttaagccttatttcttcaggataatcttgtgttgatgtaatgtttaatggtagagggtctgcttctccttcaataatgacatgttttactacaacttcaataaatccagtactgactgcggtatttatagtagagctgtctctggctactactattccttttactgtaataacactttctaatcttaagtgagtaattaattgaaaattttgattatcagcttcattgaatactaattgtgtaattccataatgatcgcgtagatctacaaaaataattttcccatggtcacgctttctgtatatccatccagaaagagtaacctcctgatttatatgttctttccttagctgatcgcatagatgtgttctatatatgttcataagatctatatttttaatgtcaatctattttatacaataatgcatacattaaaagtatttttggaagattgttattaaataatttttgggatttgtgttttagttttcctttttaagaaagctaaatcttcaggaaatgtatttgctgtaaaattgtaattggtatttaaagtataaaatttgtatttataaatattacaatcaacatatgatttctacaaatctagttagtgagtttgattattatgtgttttgtaatccttagtgtgtggttcttactaaattttcaatgaaacttataattactaaagtgttaaagtatactatattttaaaaaggtataaaatattttactatttacacactataaaaagttgtatagcataaccctgtcgctttatgcttttactgttccatatgcgttttctagtaaattttttgttgctaatttttttaattataagccagtctggttgttcagggataatggctgggcttgctgttactacaggtgcaattattacattacaagataaatcagttggtgatactatagatgatacagcaatattgattagaattaataaagagctatttaaggcagggttatttcctcaggtaactgttaaggttagtgaagggcgtatattattgataggacacgtgaaatcattggatgatcaaataaaagctgaaaaagttgcatggcagcagaaggatgtaagagaagtggtgaatgaaataactgtagataaaaatgcaattaatataaaagaaacagctgttgatactatgattagtgctcaggtaaaagcacggatcctttctcaaagtaaagttaagtctatgaattatagtgttaatacaataaatgggactgtttatttaatgggtatagctcaagatcaggaggagttggataaggttgtatcaatagcgcaaaaagtcaaaaaagtaaaacaagttattagttatgtaagattaaaggatagcaagttacgtgattaatcatctacttcaattttatatacgctgttttttacaataagtaattttacattactgtaggactataaataaatgtgtgaattacatacgtatgacatataattaatacatgtttaaaatgtacttttgtattgtaatatgtgattaattcttcatttaatataagtatgtctttaagttttaaatgttgtgtttaatatcttccaagttttttatgctagtttgctgaatcaaggtcttttttgtgaatgcttaatataagatagcatatgaactagtatgttgtttacgtcatgatcttttatatttcgatatcttaagaattttgttattctcattcaataaagtaagggttataagaagctatcggcttagtagagaaatataagaggtaatatatggcactaattgttgcttttcaaatggataaagatgttgttgttgataaggatatgtcagttaaatttatacaagaagcgcaaaatagggggcatactgtattcttttattctcctaatcaattagcagtaaaagataacatgccaattgccagagcatgcttggtaactatagaaggtcaagaactacgatttgctgatgtacaagaattgttgcttgaagatgttaatataatttttgtgcgtcaaaacccaccatttgacatgcgttatattacaagtacatatattttagaaagattaaaaagaccacttgtgataaataaccctaaaagtcttagagatcatacagaaaaattattaccactttcattccctgaatttataccagatactatagttactgaagattatattatgttgcaggatttctataataaacataaggatatagtgttaaagcctttatatagttatggtggaaatgatgttactagaatgcatagtaatgttgatattggggttatagcgaaattaatgacagaaaaatatggatgccctataattgctcaaaaatttataccaaatgtcagtaacgataagagaattattcttttggatggtaagcctataggagtttttaaacgtagaatatcatttaatggaattaatgaagaaataagaactaatttgcgaatgggatcagttccagaagttgcaacattgtcagatcgagatatagctatatgttcagctatagaacaagagttgttgggcaaaggaatggtatttgttggaattgatgtgttagatgggtatttgatagaaataaatgttacttctccatgtggtattttacaaattaatgagttgtatggtgtgtctttagaaaaaaaatgttgggattgttttgaagagaagttttatgaaaaacataatagtatatagattatgctgtttgtaaaaactagtaactttaatagtgcttctattatttgaattgaatataataacgtattaataaaaattttctgactatagggataaatgcatttagtttaatgttgtgtatttattttgatgatggttatttgatatcaagaagttgaaattagttctaaaaaattttctataccgtctttattaacatattactttaaatttttacttctcatactaatttattataacttttttatatcaaagataaatatcgattgttttgctatgttataaaaattccaagtttagataagtatatttgtggtattattttttattatctcttagtaaagggttatgttttaatttgatattgtacataatttagctttatgtaatgtgtagtctgtagtggtttgtgttgaccttaattgcataaatagtatttattacttgaaaagtttatataaatgttttaatcactgaaatgttctattgatatttttaggagttgagtttcttgtataaacgattgttcatgcatatattaatttttattattgaagttttatctggcatgatttgcttttaatagttaatgctttaaattaagttgttaaatctttaattaaaagaattatggtgttattatgagtgaaattagtaatcttaaagatatagttaattatcagtctttaagcaatgttaatagtatcagtagccttaatattcttaagtcgaccagggttttttttatacgtaagaattttattttcttagtgatcattattcttagtatgttctttacttatttttttaaaggaaaaataattaatgggttacaaaattgtgctgtggttctatcgaatcagttagttaattatgggtttgctgttgaaagggtagttattgatggaaataaatttgttacttcagactatatagaaaaattcattgatattgataaatctattttatttatatctttaagtgaattgcagaagaagataaagagtaataataaatggattaaagatgtttcagtgaaacgattattacctaatgttttacagataaaagttctagaatatttgccttttgcgaattggtatcataattatggtagttcaattattgatgatacaggacatgttattgttgatagtgaagaagaagaagatgatttaatatcaatatatggtaatgaagcgttgaaagatttacatttcataaaaaaactacttaatgagaatagtgttctcagtaatatgatttcttctatgtcttatgttgatggtggtcgttgggatattgttttatctagcggagtaaacattaagttacctaaggaaaatcctcataatgcttggaatagtttactgagtatatatgaagcttctaatgaatttttaatttggaagagtgtggatatgcgtatccctagtcaaattaatataatagaataatttattaacgattagttataatgtatttataaaattgataataaattatatattgctatgtttgtttatccgtttggatgtataggaatcctatgtttgataaattaatgataattgtaataaatttttattatatgtttaaaatttatagattaaaaataacgaattttatatattggttgttgatcattaatgtgtatagtagtattattaagtgtacttatatagagtacactgtgttttgtggtgtttcatcagtattgtaggtaattatggcacagaattttgaaatgtccaaagaaagattgtatatttctgaagtattggttgttgatgatgaagttgatattaggaatttaataaaggatatattaagtgatgataattatgtcacaaaattagcagttgatgggttgtctgctattaagatggcttatgagaaagaaccagatgttgttttactagatatatggttaaaaggatcagatattgatgggttaagtgttttagagaaactaaaggaaaggtatccatatttacctgtgattatgattagtggacatggtaatattgctactgctgtgaagtctttgcacatgggagcttatgattatatagagaaaccttttacagaaggtagattaaagttagtagttaagagagcgatagaatctggtagattgcgtagagaaaatgacgaattaaaatcaacatttgaagattacgaaatagttggcaactctcctgtaataaaaaatctaaggagtatgattaataaagctgctacaacgtccagtcgcattttaatcactggatcgcctggcgtaggaaaagaagtagttgctagattaatacataaaaaatcaaaaggatatgatacaccgtttatatcgatgtattcatctatgttgcctgcaaataattacttagttaatatatttggtagtgaggaaagcagtaacattttgtctcatagggtaccacctcatattggcataatagaacaagcaaatcatggaacactctttatagatgaggttacagatttaagatatgatactcagttacgattacttaggttattgcaagaaggaaaaatatacagagagaatagcaaaattcctgtaagtgtagatgtgaggattattgtttcatcttcaaaagatatagaaaatgaagtaagagctgggaagttttgtgaggatttatattatagattgaatgttcttccaattagagtaccgtctctagtagagtattgtactgatattccagagctgtgtagatattttatgagtagcatatgtaagaaaataggattgtgtacacatatattgagtgatgaagctttaatagcgatgcaatcttatgaatggccaggtaacttacgtcaattacgtaatgttatagagtggatattaattatgaaatctcctaaagaaattattactgcaaaagatttgccggtagatatagtatcgaattctcctatcaatgatgttctgagtgctaaagtcatatctgttcctcttcgccaagcacgtgaggagtttgaaagacagtatttgaaaactcagttgtcacgttttggaggtaatgtgtcaaaaactgctgaatttgttggtatggagcgttccgcacttcatcgcaaattgaaagttttaggattgtgtagtatatctgagtaacttatattatgtgatgttagaattagttttttaactgtgtatgtgttgttttaattaagacgataagttatatataaccaagaatactgcatcttatagtgtagcttattaaataatttgtgtagttttttactagtttctaaaattagtatgtcatagctgatattattttcagtgatgttcttacgccgaagataagtatacaaatatgtaattttattagtcatgtgttttttatctaaaatatgcattctgtttttataatagcttagcacaagttgagtgttataatatgtctgatattgttttctctaacggtatatttttataaagtaagttatatatagatgtacaaataggtaattctatattaagttcttttgctagtgatattaatggttttacagtactaacaccttctataatttttgagttattatttaacattttatttatatctgcaccctggcctattgttattccaaaagacatattccgggaatgtgctgttgtacaagttaatatcaaatcacctaggcacgatggaccaattaaagttgagaggttaatgttctggttttttgcagcatacaaagtctttatttcttccattcctttagttataacagtggctatagcattgtttcctaggttcttgcctgttactatcccgcaggcaattgcgatgatgtttttcaatgcggctccaatttgtacccctaatatgtcttggctatagattattttaaacgtcttgttgcttatcttttgtgctattgatgtacctaaagattcattttctcctgcaagcactatggtgcatggaagatcttctgcaatttcttttgcgaagcttggtccagatagtatgaatgctggattgtttggtaagatttctttcactatttcacttgggaatttgagagatatattttcgattcctttactgcaaattagtagaggtgttttttcaaatatatgttgtttgtcttgtatagacagacataatgtacgtaattgttgtgtaggtactgctaaaataatacaagtgctataatctgatagtacttcatctatgttactgcttacaattatattttctggtaatttgcacgttggcaagtatttaagatttttacgattaattgctatagattgcatatctgtatgattgcgcccccataggttgactgatgtactattagaagataatgcaaatgctattgctgtaccaaatgatcctgcacctaaaatagtggttttcatttttttgtctacttataaagaacttagttagaggcgattatatattatatattatgtggtgttaagaactgaattgggggttaatttataatattggtaataaacatttaaaatattagcagggataatttaatattctacattttgtgtttttataatttgcgtctattataggttaaaatttttagcatatgaaagatcaaaagctgtgtattgttgtaaatgaatgggtgtcttggataaaaaaagaaagaagatatgcgactaatactgttgattcttatctaagagatgttaataagtttattgagtttttgtatatgtgtgttttgcgtcctgttactttagaggatattattggtgtaaaagttgcagatttaaggaaatggtttgcatttagataccaggctaatatagaagctgtaacaaatgcaagatctttgtcagcattgaaaaatttttttcggtatttgtcacgtacttataatatagatggtcaagcagtgttttgtttatctagaccaaaacttaaaagtactttacctagaacattaactcaatctcacattcaaaaaataatagattattatgcgttattagataccgattggatagtcaagcgtgattttgcactaattgtgctcctctatggatgtggtttgagaattagtgaggcagtgaatttaaagtttcagaatattagaagagaggagcttttaattattgggaaaagaagtaaggaaaggatcttacctattttgcctatagtacgtcaaagtttagatgagtatgtaaggtgttgtccatatcatatggaattgaactcagttaaaaatgaatatgtttttgtaggagttagaggcaaaaaacttaaaaggacttattttgcaaatagaatacaaaagatttgtaaagaaatagggttgcctgatgttataactcctcatgcatttcgtcatagttttgcaacacatttatttctaggtggtgcggatattagatcaatacaagaattgttaggccatgctaatttatcaactacgcaaatttatactcatttagatcataaaagtgttatagatcattataagaatttccatcctcaagttataaaaaagaatagttgataagtacaagtcgagaaatgagagtatggttttgataaaagtgattatggaacaagttttttctgtatcttatattagtaataaaatgcgttacattgtttagtttatgtagtttagttatatgcttggtattactaacataaatttgttatttagaattaatgtgttttaatcattagtatttttaatgtttgacacaatacttattaagatattgcataatcttctgtatattttcatgtgatattgtcagttttacatgtcagatctttttaaagttgatacaattgcgttatttagaattaatgtgttttaatcattagtatttttaatgtttggcacaatacttattaaaatattgcataatcttctgtatattttcatgtagtattgtcaattttatatgtcagatctttttaaagttgatacaattgcgttatttagaattaatgtgttttaatcattagtatttttaatgtttggcacaatacttattaaaatattgcataatcttctgtatattttcatgtagtattgtcaattttatatgtcagatctttttaaagttgatacgattgcgttatttagaattaatgtgttttaatcgttagtatttttaatatttgacacaatacttattaaaatattgcataatcttctgtatattttcatgtagtattgtcaattttatatatcagacctttaaaagttgatacaattgtatttatttgaatattacttgatcttcagtatttctttctgtgatttctccaattttgtatacaacttcatctgtaactttgaggagtgacaatacttgatcttcattttcttgtgaagtgaccagtatcataccaataccacaattgaatgttttgagtagttctgtttgctgtatttgtacttcagtattaagccaatgaaatatttctggcattttccaagaacttaagtcaatagttgctgacaaatggctaggaataatacgtggtatgttatatgtgaatcctcctccagtaatatgagctaaaccattcactaatggaatagtagataataaagattttacatagatgcgtgtaggcgtcagcaaatagtttgcccatgtttgattagaccaaggacatacatcatgatagttaattttattgtcactgataatttttctgattagtgaaaaaccattggaatgtaatccacttgaagctaagccaagtattttatctccaactttaatattatgactttttggtaaaatgttgtctgcttcgataatgcctactgcaaaaccagctaaatcatatttattgtcactgtacattccaggcatttcagcggtttctccacctattaatgctacatttgcttttttacatcctactgctatgctattaatgatttctaaagcagtatcatggtttactttacctgttgcaaaataatctaggaaaaataatggttctgctccctgtgctaaaacatcattaacacacattgctacgagatctataccaatagttttatgattatctactccttgtgcaatacataactttgtgccaactccatcagttgaagatactaggacgggtttgttgtattcttttattcttgatatgtcaaaaagtgctccaaaggaccctatactgtcaactacccctggtatagatgttgatgatgcaattggttttattttttctactagactgtttccagattcaatattgacaccagcgcttgagtatgttttcataaatgccttactttgtgaaactcatttttacacttaattaacagcatagcattaaatatttgaacttcatataaaaaattgtttactaattagtgagattatttttttttgatatattaaaattggaaaacgtgatgttgaatatagggtttttatgcaaaatagtgatattttatcaaatatagaattagtatctgcaaggctgttacatgatcttgcaggatctgtaggagcaatagtaaattatatagaatgtttgagtgaagatgaaagtgtatctgaagatatggtacctttactttctgatgcggctaatgatgtaatgaataagtttaagttattgaagcaagcttatagtatttctgatgataatggtgattttaatactactgaacataatataaaaaattatctaaaaagaaaaaaaatcgttcttgagtgggatattaatgcacaaatttttgatgttgaattggttgagaaaatcaataagttacttattaatgtaactatgatattaatgttctttatgataaatggaactaaagtgaaagttgtattatctaaatcaaataataatgattttttgatagaaataatagcttttgcacaaaaaatagaaatacatgagagtattcaaagtattcttgatggagatatgtttaatcaggagttaaatacaaaaaatgttcaagtaaattttctgatgatgcttttaaagagttataatgcaaaaatgacatatgaaatacaggatactatatttaaattttctatatttatttagtgataaacttactgttagtacattaggcatttgtgcagtatttatgtaagttatggtaactttggggtacagtttatctttgtaaaatatagaaaaactataaaagtaaggtatcagctactaaatgaaaaatttagtaagtgtatttatgaaatgttagtacttttaattgtgcctccacctgcttcttgttgtgcaataaatagtacattacttatatttgttaagagttgtactgagtcaatttcgttatacatttgagcatagcctactgagatctttgcatgtgaatcttgaaggttattgttaatgttcttatgtattctagatattgctgaatatgcatgttcagatttacatcctaataaaatacaaataatcttatggttccctatatacccaattatatcactttctctaatgtttttatgtaataaattaatagtttgttgtgttaaagagtctatattggagctattatgtggtgggtctagttgtatcatacttataacggcatgtgtattatatttatggagaaaatctaatatgatctgtacttctgtctttgtggatgcttcatccattatattaaaagtagggtgcatattgtattttgtattgaaaattactgattctttaaatatatccaacttttgtgatatgctaatatctcgtattaggatttcatagtttattatatcttgattagaagctatgactctaaaaacttttggtgtgactggtattgctttgttatttttcccaataaaagaacaattgcgtgtttttgataaaatgtcaaataagtcagttccatcacttgtatattctaaatagctatttatattttccacaatatttttatgtagtatggttgataatggtttattagaaagttcttctactgtatattctaagagtatttctgctggtttattcaggttagaaattgttaaattttgcaaagtgttgttttgttgtactgatattacagagtcatcagatcttcttgcaaccacgaagtgattcatgtttttctcgttttatcaattaaacattgcattaaaatctgtttgttgtcccatttgtataaaaatttttctttgttattttattcatgatttgtagttaatgaattattcataaggtatttttattacataatgagttctggtatgttttttattatgtaattatttaaatatttatatgggtatagtttagaaaaagttaggatatagcttattattttggtgggtaggactaatatagaaatgagatgagccttgcatgctgtactcttcttgtgagttttaagatttatttttaaataggactgcttaatatgaaatcgatcaaatgtgttaaaaattacgtgtattgggtctatctaattaaccctaataaatactcgttgtattaaaaatgttgtgttatggttgacatatcacaatttttcattttcttcatgtacttgagaattccatagattttcaagttgataatattctcttacttcaggtctgaagatatgtattaatatgttatagcagtttattactacccagttgccatcttttaagccttcaatggatagttttttatgaggcttaatttctttcctaattctttcagctagtgatttaacatggtagcttgattcacctgaagcaattattaaatgttctgctaagttgcttttattactaatattaattgtaacaatgttattagctttatgtttatcaaggataaatactataagctcttttagctcttctggagaactaaatggttttttagatttactgagattcattttacatcgttctttagtatactatatctattgtattacatattggatgtaatacaaacagttaaaaaatgttaaaagaaatgtgtttatgataaaacttgtctatattattaacagttgctaatgatgtagtggattgttaattttcttagaaggtgatctacaatatgtataatatatttcagtaaatatggaagttggttaacttatgaatattaaaagcgtgatattatttctaagtattttgctttatagcaatgtatcattttgtcaagatggttacatgatatttagagatagtgaagtcgaggctgtaataaagaaaatagcatttccaatatttattgcagctaaaattaatcctgagactgttagagtgtttattgttaatgataaaatggtaaatgcttatgttgatggtaataataatgatgtgtttttgaattatgggttatttgagttttcaaatgatcctagtgtacttattggggttttagcccatgaagttggtcatatatctcaaaaacatgtgttattccgtagaagtaaagtacaaaattctatgattttgtctgggataggatatgttctaggtattattactgcaattacagtaaatcctgatatgggacaggcaatagcacttgctactaatgatattagtaaaaaaatgttttttctttatagtcgtttacaggaggcgtctgcagatcaatgtgcattaagatatttagatgaagctgggtatagcaacgatggattaattaaaatgtttaagcatttttattcactggaagcacaatatcgaggaaatattgatcaatacttattatcgcatcctcttagttatgataggctgttgcaaatacaaaattatcgcaatcgtaatgaggttcatggtttttctgatgaagatgtacagaaatttaagcgagtagtagaaaaaattaatgcgttttttaacccagtagaacgtttggttaatgataaaaatgatataaatcaattatctccatacatacaatctattattttttataagcaatctgatgtttcaaaagccttagaaaaacttgataatctaatactacaatcccctgaagatccttatctttatgagctgaaagcacaaattttgtataaggcaggtgacattaaaaagtctgtagaaaattataaattagcgcttaagttttctttcgatgatgttttaataaaacttgaaacatcacaagctttgttattgtatgatcagaaggaagcagtaaattatttggaacaagtgacataccaagaaccagataatgtttttgcttggaagcaattggctgtagcttatggtaaaataggggatttgggaatgtcgtatttttcactggcaaataaatctttttttgaaaataatagaagagattttgataaatactttagcttagcaagaaagtatttaccaaaagatagcgtacacttagaacgtatgcgtgatctaaggataaatttattaagtaatacataagttatttaaattactaataatattatttatattttaataaatatgtagtagtttattaccttatgctaaggtgtggtaattttaatgaagatacaaaatgctatattttttttgctaatgctgcaagcttcctgtagccctatttatggtattaaaaaagaatataaaggaccggaaaatgaatctggaaaagcttgtgtagtaaagtgtgcttacgtaagaaatgactgttataggcagtgccaagttgatatgacaaattgtcaattaactgaaaaaatgatcaatgctcaagagcgttctcaaccacttgtgagtataataaatagtaatggaaacaaacaaaataataacttgaagaataataatggtcacccatgtaaaagtgagaacataaaatgtaaggagtcttgttctagtgatattatgtgtaagactcaatgcgatatgtatatggatatgtgtaatgctcagcaaaattttaatggtcatgacaaatacgataactttgtttcaagtatagataaaaaaagcgcaaacatcacagtaagaaaacaaaattctattagcttatgcagtagtaataaatgtgatagattatgtacaaataattatgatttatgtttttctagttgtggtggacaaataattacttataaacagtgtgtagcattttgtgataaaaataaataattattttctacctttattgtataaataaaactaatgaataattttataaatagtttgtatttctagtgttaatgaaagttgtcattaccttgttagtatagtattgatgtggttgttttgtatttatgaaagttttttagttttatgataaatgagcatgtgcagtttacgttttttgattctgtagggcagattagtttttatttatgtaaagtttatctttttatggatatacttgtttaaaaatttgcatatttctgaatatgggtgttttggttagacatggggggatacataaaggattctgtgtgttagattacattgcatgtattgtagagttatggatgtgcttgtattaaattttcatatttctgagtataagtgttttgattagatgtaggagatacacaaggattctatgtgttagattgtgttgatatttgatataatattgcatgtatcgtatgaattatggatatgcttgtattaaatttgcatatttctgaatatggatgttttggttagacatggggggatacataaaggattctgtgtgttagattacattgcatgtattgtatgagttatggatgtgcttgtattaaattttcatatttctgaatatgagtgttttggtgagatgtaggagatatacaaaagattctgtgtgttaggttgtgttaatatttaatatagcagcatcctaagttgtgtgatttactggtgttatagtagttttgtgtatttttgaatatcagcagaaaataatattactgttgcaatacatgtgaattttgttttattaggttaatattatttagacttagaagcatttcatatattggtatttgtaatactggatgaatgaacctagcatagatatcacataatggtactaatacaaaatctctacaatgcatttgttgatgaggtatagataacgtttgtgaatccacaactttgtttccccacaatataatgtcaatatctataggtctaggtgcccaacgttgatgattaattctaccaagcattttttctatagatttaattctttctaacatggcagatgaagacaagtttgtatatcctgatactaccatatttaaataaggtgtatcccaatgatcagctgcattttctggtaataaagctggagttttataaagataagaataatttttgttatgtaaaggtaacatattaattgcggatttaatatatgccagcatgttgccgcagttacttcctaacgctaacattacaacatcgttaaacatatttttttttagttgtttaaaattacagggtatttcattttgaaagtaatttcaatgttattgtggtgcattaaagtgttatgtaaaaaattttaaagggattgtttataggtttaatttttttgtttgtattacttaaataatattattattttttttatatattactgatcatatatttgtgtatgattgtattttcatattactgaatttcttgtaattgtgttcaagtatgtttaaatcaatagaacatatatcttctataataagagtgtttgtagaggttactttgcctatgtttgcatatggaacttctttaaatattgcttcaaacctttgcttattgtgttctcctattgttactaagatcctgctttgtgattctgaaaataaaatgactttttctcttaaagtgttgttgtcaatattatatgttggtattgctgataagctaatctcagctccaagttgtcctccaataagtgattttattaaacttattatcatgcctcctaagttgactgcaattgctgatgctataagatttgtattgatggctttgttataagatatgtataattttttagcatgttcggcgtgtacttgtggtacattattatttcctagaccactgtatttttgatattcagaacttccaagctcatcataagttgtacctaatatgtatattaagtctcctgggcttttgacatcaagtgttacagcattctcaacattttcaatgattccaagagtagaaattaacaatgaagggggtgcggaaatattaatttctttgcctttgttattataccctttaaagtcattaaacatactgtctttaccagaaataaaaggtgttctaaatgctatagcatagtcataacatgcttgtgctgcattttttaattgccataatctttgtggatttgttgagtcacaccagcagaagttatctaataatgctaagtgattgaaatttcctcctactgcaatatagttacgtatggcagtgtctattgcacaggctgccatgtgatatgtgcttatttctccataacttgatcctagtccgtgtgatttcactattcctttttttgatgataatattggtttaataactgttgcatcaccattgactcttcctttgccttgaataggtttgattatggatgtaccttgtacttcatgatcatattgtaaagatatgaattctttactgcatatgttcattctttgtatcatctcgttcaactcaatttctaatggtttattgtgctttttagggaatattgattctgtagtttttgaccatggactagtatgtaagtggatttttggaacaccattgtgtagaaaatctacatctatatccataataacagaccctttaaatagtactactgctttattgctattattgaattctccgataatgctaatttcaatatcatgttttttcatcactttttcaaatattgagaatttattaggggaaacagcaaaggtcatcctttcttgggattctgatacccaaatctcccatggtgacatattatcgtgcttaagtaacactttatctaattctactataaaaccattattacccatttctcctatagaagaagataatcctccagctccattatcggttattgcgttgtataaatctaaatctctagcttcttttattattgcgtcagataattttttttgagtaataggatctcctatttgtactactgtactgctgctattatgttctgttaatgcgttagatgaaaaagtagcaccatgtataccatctcttccagttctgcctcctgctattactatgtaatctccgttattgggattttttacatgtgataaggatttattaattgtacgtggcataataccagtacatcctacaaacaccagtggtttactgcgaaatctattatcaaagtatgcagaccctagacttgttggtattccagaacagtttccaccataatttacaccttttattactccatccattattgtattagatgataatacttttgttgtgcaggacttgtctctgtataattcttcgtctgattcggagaagcagaaatagtaagcatttaatatcggttttgctccttttccaaatccaattatatctctatttactcctaatattccagtaattgctcctccaaaagggtcaagtgctgaaggactattgtgtgtttctactttatctgcgataatgaagttatcatcaaatactattgctcctgcattatcagaaaatgtggatacgcatatttctgagtttatttcatatgttgcacgttttatgtaatgtttatagagtccatctgtaatttcatctataggtgaggagaagatgttatgtttgcaatgctctgaccaagtttgtgctagtgtttcaagttcaatatcattaggattgcgttgaatttttttaaagtatgcttgaatggctttcattgcctctaatgataagtttaaagctccgcgaccattaattccatgtttgctgatttgaattaattcgtgatcttgaatatttagatctatggaagtaacagtaacgttttgttttttgttttgtgggaaaagatcctcatacttgacatatggtattatgaatatgctactgcatgtagaagagtcagcatatatgttgtttaggtttgatatctgtttatttccaaaaaattttactttgaatgtttttcctgttacaaaggacaatttacaatattctattaacggattgaatagctgcagaatattttcttcttgtggtattggtccttgtccgaatgttactttggacgttaatacatctgttgctgtgttatatccaagcatttcatttattatgcattttgtagtattgccaacattatcagtaactctaggtaagaaccctttttctaatgaccagtctgctttaaaggtatcgagtagattatagttagtattagtactaacatctttgtaattttgctctgtagtatcatatgtgaatgcaaaaaattgttgtgttattgaattagttagcagagaacctattttttttataattgctgtgcttaagttatgttgaacattaattgtataaactgtgacatcattacttttgtagctttttggtagtactttatctgctacgccgatgcgtataatcataagtaatttttaattaagtaatatatttacactgtataataattaggtgtaatttcaaatatattattaatatttctggtaattattcataattgcagtaggtaatagactggtcttattgtataatttatttctatctatagggatagaatagggggaaccattaaggttttgcttgcaatatgtttatcattataatgattagtgataatttcaatatttctgatagatatttaacagcttgccaggtaaaaataagccggattctgtttatgtagttattcatctgggatagatatcgctacctacctcacgcgactcacctgggtaattgtgagggaaaacacaaatacctcttcttagtcttgctcctggtggtggttacttagctactatatgttgccataagtacggtgtgctcttaccacgccttttcacccttaccttgtaacaaggcggttattttctgtagccctttacctagagtcacctccgacagggattacctgtcaccattttcccttggagtccggactttcctctgtactttacaatacagcaactacttttttacctgacaagccattataatttctaattgtattaagtaaataattaatttatatggattgaaaatatggttctctttgtttgaaagtttggataacagtttcctattatgattacaatcaatgcagaaaattaaaaaataattttttgacaaaatgttaggtttttctgctgcagataaacgtatttaattgtgtaagaagcgttaattttgtgaattgagaagtacaggttcttttgttttaattccaagcttggataataggtttttatcatcatcacaattagaattaggagttgttaataacttttctccgtagaatatagagtttgctcctgcaaataagcatagtgcttgcatttcttctgacatatcttttcttcctgcagcaagacgtacatatgattttggcattaaaatgcgagttacagctatagtcttgataaaatctatgttatctacttttatgttattttcaaaaggtgttccttttattggaactagcctattgattggtacagaacgcggatgttcctttaaatttgctaaagttaatagcatctttgctctatcttcaatactttcaccaagtcctagaataccaccagaacatatattaattcctgcttcatatatgttatttaaactagctagcctatcatcgtagttgcgtgtagtagttacattggaataaaaatcacgagatgtatcaatattatgattataaaaatctaaacctgcattttttaatttttttgcttggtccaaagttatcatgcctaaagaagcacagctctctagtttttcactttttattaggttgatgatattgcaaatatattctatatctttatctcttaattgacgccatgctgctgcgaaacaaaatctgtctgctccgctatttttggctgtttgtatagctttttttatgttttcaacatcaagtagagcttctttttgtaggtctgttttataatgtgcactttgtgaacaatatctacagttttctggacatccaccagttttgatatttaataatgcagcaagttgtatttcattgttattaaaaaactgtctatgtgttaaatgagatcgtaatattaagtcattaaatggagtattgaaaagctctaatatttcatctaattgccagttgtttcttattgtagtacatgtattcatttttgtgataactgtttttcgatttcgttttgttttgatgctatttctcttacagagctacttaaagtgtcaagttcatcttgagtaacaaaaccactatttcttaagtatgcagataaacactttttaactactctgttagtaataccaagtgtacctatagctattccaaagagcgatacactcatctttgagatatcatgtaaaaaaaatctcataaactacctgtctacaactaaatgaaacttacaaatgttttgctctcactaggtgaggaaatgctatgcaattttagtaaaacagtcaactaattttttaaatattttgataacctgcagcactgactatagattgttataagatgaatattttaatatattcttcctcctattactcctattatgtgagttacttcgttgttttcaccaataggtaataaacattgtcttatctttatgtaatttccatcagcactttcagtttctgattcatccataattggttcttgattctctacaactgattctaaataatcaaatagattctctatgacttgtggaaaaaagagcttaatgttttgggattcagcataaactttaatatttgattgatacagttccatggctctttctccaatatatatgcaattatatttttggttatctgtatcattttttacttcaatgataaagcagttaggccagatttccctgatttcttcttgttcaatttcttctatcttaggaaacattctatcattacgtaactgattccagtatgcaaatagtatttttattgctcttctttctgatacatattctgacatctataaccttgatcttgtgatgaacataaaaaacttacagtaaatgtctttattttttcttacttattctaatttttatttaattataagctgtgtatattgctctattataatatggtattttataatatttgttttggaatgaccgatagttttatgtcttctataagattgtttagcgaataaaaaatactgttttaatggaaacaaacattttttcggatataacagtattattgctggtgtatgttggcttaagtatgaaaacatggaacatgttttactcaaagaagagttatttatgtcttacaagcttcttgattacttacaattgatgtatagtaatgggttgactgcttgtccatgtttacgcatagcaaaacataagtatgatttatttttttgggaatttatacttttgatagatcctatagcttggccttgtgttactttatcacctatttttacatctatactatctaggtaagaatatgtagtaattgtgtttttgttatgctctattattatcatgttaccataccattttgatcctttgcctacgtatagtatttttccagaagatgatgctctaacctgttgtgctccattagatttgatgttaattccctctttacaatttctatcttgattgtttatagagaacttagatgttatgataccttctatgggcataataaaattgcactttttatcaatggtttttatttctttcattacttgatgattatcttgaattgtatgtgattctatgttctcgtcctttttaacatcatgtcttacaaggtgatattcattgatgtcgtctaattcttttttaccatgaaattcttctcctcgtaaaaaagaaggggcaggtttttgtgtacaaccaaaacataataagacaatcaatagtgtttttcttattgtcacatgtacctacgaatattagatattcttgttctatactattaattttatatattattctgttatatgaatttggcaatgcaaaattcatttttattagtaattaattcctgaaaataattttgtcagaacattttgatgcttttggaatgtgcttttattaagtagattgaaggaacacttacttgattgttgtagtctgtatagttatgtattaatgtaagtgtagtatgataatttgctataaatatatttatagtattatgatgtgtttgtattataacaatatggattttaataatgcaaagtttaatatttaaattattatcagttactgaagctgcagctttagcatcttataaatgtcttggtatgggtaatgaaaaagaagcagatcgtgttgctgttcatgctatgcgaaagtcattaaacttattagaaattaatgggactgttgttattggagaaggggaaagagataatgctcctatgctatatattggagaaaaagtgggtattggaggaattgatgttgacattgctcttgatccacttgaaggtactactatgtgtgctcattataaaaatggagctatgtctgttctcgcaatagcgaaaaaaggtgaatttttaaatgctcctgatgtttatatgaaaaaaattgctgtaggtcctaatgttcctaaaggtgtggtttctttaaaatatgatataaaaactaatttgtataatttagctgaggtcagaaagtgtaatgtaaatgaactgattgtaatggttttatatagagaaagacatttagaattaattaaaagtattagagaatgtggagctcgtataaagcttatagatgatggggatgtttcggctgtagtatcactgatgaaaggaactcatgatttatatgttggaactggaggagctccagagggtgtacttgcagctgctgctttgtcatcgatgggaggatacatggaaggtaaactaatttttgatacagagtatttaagagcaagagcagaacaatttggaattaaagatataaataaaatttactctatagaagaaatggtgaaatctgaatcaatttttatagctactggtattactgatagtgctttggttaaaggtattagatattcgcaagggtcttttattatagagtctataatcattaaaccggctagtgttatgtatgttaataatactgttcctgaggtatagtgggttattttaatgcttattgcaatcttatgtaaatattgtggagatgtataatagagctttgtagtgtaatttgaaaattttttataaaaagtgtgaagctgttgagtctgtaattagaaggaattatctagaatatatttatcataaaagaaagtattgtttattggtaaaattttctgaaatggtttttatatctgatacataggtatgaaacatatttcataaactaacaactggtggtgaaaatacttttatacatgttgatatgtagcttagttttgtttgttgattaagcttatgaagtctttttacttttataatgaggaattatctagatatatttatcataaaagaatgtattgtttattggtaaaaccttctgaagtggtttttggtatctgatacatgagtatgaaacatatttcataaactaataactggtggtgaaaatatttttacatgttgatatgtgcttagttttgtttgttggttaagcttatgaagtctttttacttttataatgaggaattatctagaatatatttatcataaaaaaatgtattgtttattggtaaaaccttctgaagtggttttttgtatctgatacatgagtatgaaacatatttcataaactaacaactggtggtgaaaatgcttttatacatgttgatatgtagcttagttttgtttgttggttaagcttatgaagtctttttacttttataataacgtaaatagatcaaaatattagtaattgctgctggtgttattccaggtatacgtcttgcagagccaatggaaagtggcttgatatactctagtttttcttgaatttcttttgataggccatggatttgtgaaaattctatattgtgtggaatatgtgtattttcttcttctagaaaagccttaatatctgcatcttgtctgtcaaaataaggtgcatattttgcttctattgccacttgttctgcaacatttttgttaaattcttttactgtgttgcatattcttgatacgatttccatatttatatttgggtgacctagaaggtcgaaaatactcctccttaccccatcttgagatataggtatattatgcctagcaagttgtgtaggggttgttatgatattttttaaaatatttgttaaagttattatttcctgttttttgttctttaaaatggtatatcttttggatgatacaactgatatttgatatcccagttctgttaaacgtaaatcagcattgtcggaacgtaaccttaacctatattctgctctagatgtgaaaagtctgtacggctcagatgttcctaaggtaactaaatcatctatcatcacaccaatatatgcatcacttctttttagtatgaaaggttcatactttgagttgagagataatgctgcattgattccagcaatgatcccttgccctgctgcttcttcatacccagtggtaccatttatttgtcctgcaaagtatagaccacttattttttttgtttcaagagtatgatatagttctcttggatcaataaaattgtattcaacactgtaaccacttctgattatgttgactttttctagtcctggtatggtcttcaacatttcatattgtacatcgagtggagatgaagtggtaattccattaggatagataatgttagaatctaagccttctggctctaaaaatacctgatgactattacgttctgaaaatcttcttactttttcttctattgaagggcaatatctaggagcctttatatcttttagtgaattacttgctgctgctctgtgtaaattattttttattacctcatgggttctagtattagttgcagttaaatagcatgaaatttgtggtaaatctattgattgtgacatatatgaaaaaggtgatggttcagaatcacctttttgttcttgtaatcctgaaaaatttatactgtttatgtcaagtcttggtggagtgccagtacgtaagcgacctaacttaaaattatatttttctaacgtttttgctaaaccaatggaaggttgttcaccaaatctacctgctggagtattataacttcctatgtgtatggttccttgtaaaaatgtaccagtggttagtattaatttttttgtgtatattacttgctgatcagatgtaattacagtttcgacggtgaatttttcatctttttctgttatagtaaagtcttctactgatgcttctaacactgttaaatttggatagtttagtatgatatcctgcatagtgtttttatatatttttctatctgcttgtgctcttggtccccatactgctggccctttgctcctgtttaatatactagaattaatgctagctttatctatgacttttcccattaagccatccagagcgtcaacttctctgactacagtaccttttgcaattcctccaatggctggattgcaagacatttctccaattgttgatgtagaatgtgtaatcaacagggtttttgcaccgatacgtgctgcagcagcagctgcttcacaccctgcgtggcctcctcctataactactacatcataatgatccatataagcagtataatatgttgaatactaagataatggtagtaattttattaaaattgtcaataaagttgcattctaatataaagtttttatatcataagttacttaaagatattaaataatttattgtatttttttaaattgattgcaaatagtatttttagcttaatatctaaacatattctcagaaaagaattttttataatagtgatattgctgattagatataaacattgtttagtggttttgttagcttgtattcagtatattaagtgtttttttgggttgaagaatatatagttaattatgtgtttgtttatgtaagtttattagatatgttgttgtagattaataaggttatttgttacatagaatttaaatgaatttttttagatgtagttagtagatgttatatctaaaagttgaggacttgtttacatgattttcaataaatggagtttaagtgtttactttttgtgttaagctaatagtttatatattttgatgaaaaaaatgaaggtcattgtattatctggatatggtttaaattgtgaagaagaaaccctgtttgcttttgttaaggcaggagagttattgtcatgtgatgtgcagggaaaaatagtgcatattaatgaagtaatatcatgtcctaatttgttgcgagattataatgtacttgcaattcctggaggtttttcctatggagatgatactggtgctggaaatgctttcgcattgagaatttttcataacttaagagaagaaatatcagagtttttggctggtgataaattagtaattggtatatgtaatggatgtcagatactgatgagattaatatcagattttgcgtgtataacacttttaaataattctgttcgacaatatcagtgtagatgggtgaaagtgaaagtgaatttatcaaataattcaccatggttaaaaggattaaatgaattatatattccagttgcgcatggagagggaaggttttttgtagaaaatgtctctgtcatttcttctattgagaagaatattgcgttcaggtatattaacaatgaaggtaattatgcgaatcaagaatttccttgtaatcctaatgggtcagttgccgatattgctgcactgtctgacaatagtggtaaagtattggttatgatgccacatccagagagagcaatgtttttcacacagcaggataactggacacagataaaagaacaatgtttaagatctaatattgcttatcctacttatggagatggaatgaagattttttgtaatgctgtgaaatatttttgcaaatgatctaaaaggtattttgtaagttttaatgttgttgagttttatcaggtttatcattttattacttttatgtttttggtattactgcatataaaatataaacttatataaacttttgtgggatcgataagtgcttaagatctaatattgcttatcctacttatggagatggaatgaagattttttgtaatgctgtgaaatatttttgcaaatgatctaaaaagtattttgtaagttttaatgttgttgatttttatcaggtttatcatttttatgtttttttggtattactgcatatacagtataggcttatataaacttttgtgggatcgagaaatatgtataagctacaagcagtgatatatttgttgattttagttaactatttttgatttatgaatgtgctatttagaatttcaatgtttttattgggaacattgtagaatgtagtcaaaatttattgtattttgagatcaggattgtgtaagaaatattgtgtaaggaatgtagtgatggtgaattgttattgtacgatatgtaattattataataggttatgggttttaaagctgtagtgggcattagatgtaactatgacatgatctattagtgttattccgacatcactgcatgctctggcaagttgattagtaatttcaatatctgctttagaaggcttagcatctccactgggatggttgtgggcaataataatggatgtagcttctaaaaatagagatttttttattatttctcttacatatagaggagtttggtttacagtgcctacatcttgagtttcatctgcaaggagtttgtattttgtatttaaatataatatatgaaagttttctacactgccattacctatctttatcctaagatattctattaacttttgccattgattaataattgtgcctttatcaatattttcacgtagaattctgtttaatgcttctctaatacaaaaaattgctgatattgcaacttctcctataccggatatttgcttgagttgactgtaatcagcaaaaaaaacttttgcaaaagttccaaaatgttcaattagctttttagcaataggttttacatcttttcttggatgtgcagaacatagaattaattctaaaatttcataatctagtaaccctttgtttcctttagatagtaatttttgtcttagcctttttctatgtccaatttgttgtttttggcgttcatctttgatattcattaacttacttaaaaaattaactacttaaatatcaacgatgttttcagtatcaagtcaattgattttttatgtgttatgtaaactgttacagagtaatataatatttctactgggtcctataaagttctaaccttgtaaacatttgtgcaatatgtattataaaatttattgattgatacttgaaattagatttcttgatattatatatgatcttagctagtagtatctgatgctactgataatttatttttttatagaggtagtgtatgaatctaaatatgttacatgataatgtgttgattgaggctttggaggagtgtaatagtagttctcctatacagcttcctgattcagctaagaaaaaacctactcaaggtaaagttgtggctgttgggccaggtgtatacaatcatagtggcaatattcttcctatgactattaaagtaggagatgtagttttttatcgtcagtgggctggtaatgaaattgaattccacgataaaaaatacatagttatgaaagaaagtgatatcattgcaaaagaagcatagtcattacattgagtttaaatatgctatacatgtgtttttttgtaatagcctaagtataagtagttttaattaattttttattaaacggagattaaataacatggcaaatgtagttgtgactggtgaacaacttgataaatcaattagagaagttgttcgtattttagaagatgctgtaggatgtacggctgggcctaagggacttactgtagctattggtaaatcttatggagctccagaagttacaaaagatggatataaagttattaagagtataaagccagaggatccattggctcttgctattgctaatataattactcagagtgcttctcaatgtaatgataaagttggtgatggaacaactacatgttctattttaactgcaaaagttatagaagaagtatctaaagctaaagctgctggagcagatattgtgtgtattaaagaaggtgtactaaaagctaaagaggctgttttggaagcattaatgtctatgaagcgtgaagtgttgtctgaagaagaaattgcacaagttgctactatttcagctaatggagataagaatataggtagtaagattgcacaatgtgttcaagaagttggtaaagatggggttattacagttgaagaaagtaaaggctttaaagaattagatgttgaaaaaactgatggtatgcagtttgatcgtggatacctttctccttattttgtaactaattcagaaaagatgttagtggaatttgaaaatccttatatcttactaacagagaaaaaacttaatatcatacaacctatattaccaattttggaaaatgtggctagatcaggaagacctcttttaattattgcagaagatgtggaaggtgaagcacttagcactctcgttttaaataaattgcgcggtgggttacatgtagcagcagttaaagcgccagggtttggtgatagaagaaaagatatgttaggtgatattgctattttaactggagctaaacatgtaataagtgatgatcttgcaataaaaatggaagatctaactttagctgaattaggtactgctaaaaatatacgtattacaaaagatactactactattatcggtagtgtagataatagttctgctaatgtacaaagtagaattaatcaaattaaaatgcaaattgaagcttctacatcagattatgacaaagaaaaattaagagagcgtttagctaagctatcaggtggtgttgctgtattgaaagttggtgggtctagtgaagttgaagttaaagaacgtaaagaccgtgttgaagatgctttacacgcaactagagctgctgttgaagaaggtgttgtaccaggaggtggtgctgcattattatatacattatcagttcttgaaaacttgaagagtaaaaatgatgatgaacaattaggtattaatattgtaaaacgcgctttacaagctcctattaaacgtatcattaaaaactctggatcagaaaatgctccatgtgttattgctcatttgttaaaacaaaatgataaagagcttatttttaatgttgatacaatgaattttgcaaatgcttttacttctggggttattgatccactgaaggtagtgcgtatagcatttgattttgctgtatctcttgcagcagtatttatgactctaaatgctattgtagtagatgtaccatctaaagatgatgctaatgctggtgctggaggcatgggaggcatgggaggtatgggaggattctaattaatagataatcttctatattgactaatggggtaaagtcttttaagactttgcccccttcttttagtttatgtttttcaaatatattgcctatgtaataacaaaaagactgctatagtttattatatgttgtgtcaaatatgtaaaatgttttggctattctttatttttataatgtcgttaaacttattgttctataattgtatttgttctctatttagcgttgcataaagtataaacattttgcttgcgcctaatctgtggtagtggcttgctttttgattatatgttagttaataaacattattcggtaaaagtatagtgtgatattattataagcttttcagatttgtactatgtgtaatataagtgattagcatagttatacaaaatatatggtaacagtctgtttctgttcctgtaaaagaaaaatatgatcgtttaccttagtttagcataagaacttatttaataagagattgattgacatgttgaaaatctgtcttgattgttatgaaataaagtatagtagggttaatttactaaagcgaaccagaattaatattatctttaatctattctatattgtaaaataagattgttatatatatgcttgattgtattgtacagaatgctaattttgctaggaaaaagagctagcattcatcttctgatcctattttataaatctgtcctgtaacattgcattgattagatgatagttcaatgaatttgtcagtaaaattttctggaaggactgattgtgcagtttcttttattggtagtgcttgagcgtatatatcattgtccattagtgatggatataccatgttaacacataatttgctatgctttgtttctgtagcatatattcttagcattgtttctaaagcagctttgcttgatgcatatgtgctccaatatggatatctagatggtgattgtgtgacctcagaagtaacagcaattaccctaccagctggggaaagtttaagtaatggatcaaagtattttattaaatgccagttagctataaaatttatatccattatccttttccatgtatcatattcataatcttgtgtagggctaagatctcctaccactgctgcgtttaatattaatatatctatatttttaaacttattgcctatagacattgcaaaattttttattgtatcgaaatcctgaagatcaactgctgctaacattgcatcacctcctaactcttttatagagtcatatacagcatttaatttattaatattcttagctactaagataaggcaagctccttctttagcaaatctttttgcaacagctgaacctatgcttccagaagcacctgtaattattgctactttacctgctaattgtttttccatacagtaccctatcatcttttgatattcagatgataagcagtatcaattaagttggcaagcaaaacagtagaacgtgtaaattgtagatattcaatttactgctagtagagaatttagttaatgtttgattatgatagatattctataaaaatgttaatatattattgttattagttatatgtattacttacattaagatgatggatttattataagatacttatactatctgtattggcatatagttattaataaaaaaatatcttagtaataaaattataaaaacacctttaatttttataaataatgtttatatgtaagttagatcatttaggtgaggctagttatggatctcaatcaatttactgatatgtcaaagaatttaataatgcaggcgcaaactacagcaattgcatcagggcatcaatctttgataccagagcatttacttaaagtaatgttagatactaaagatgagcttattgagctgttgctgacttcatgtggatgtgatattgataagatatacagtgatataaaactctccttaagtaaattacctgttgtaagtggaagtggtagtggtcatatacatttatcaaaagaaatggctcaggttttagaagaagctattagtttagcaaaaaggaatcaggatacttatgtaactgtggagagattattacaagctcttgcagttgttaaagacactagtgtttacaagatactacttgcacatggagtaactcctgttaagttagaatcactaatacttaatatgcgtaatggatctaaggctgatactattaatgctgaacataaatttaatgctctgaaaaaatatgctaaagatattacagaatctgccatggctgggaaacttgatccagttattggaagagatgaagagattagacgtacaatgcaagttttatcacgcagaacaaagaataatcctgtattaattggagaacctggagttggtaagacagcaattattgaaggattggcacagcgtattgtggtaggtgatgttcctgttggactaagaaatgcaaaaataatggcactggatcttggaatgcttgttgctggaacaaaatatagaggggaatttgaggaaagattaaaatatgtaattaatgaaatagtggcgtcaaatggtgcggttatattgtttattgatgaattacacacattagttggagctggtgctacagatggtgcaatggatgcatcgaacttgttaaaacctgctttagcaaggggtgaaatacattgtataggagcaacaacattggatgaatataggcaacacatagaaaaagatgctgcattggctagaaggtttcaacctgtgtttgtttctgaatctactgttaatgatactatctctattttgcgtggattgaaagaaaaatatgaagtacaccatggtattaggattatggatagtgcgattattgctgcttcaactttgtcaaatcgttatattacagataggtttttaccagataaagctatagatctaattgatgaagcagcaagtcgtgtaagaatagagattgatagtaaacctgaggtaattgacgaattagatagaaaaattattcaattgaagattgaggctggagttttagaaaaagaaaatactgaatcttcaaaacagcgtttagcccaattaagtgaagaattgaataaattaagtattcaagcaacagaattaaatagtaagtggcaggctgagaaaatgaagatattaaaaatgcaagaatgtgtggaaaagttagataatgcaagaaatgatttagaaaaagctcaaaggtctggtaatttggcaaaagctggcgaattgatgtatggaattatcccagaacttgaaaaagagttaaaaaaatgtgaaaaacctagtagtaacatgttgaaaagggaagtgactgaaagtgatatagcaagtattgtatcacggtggacaggtattcctattgaaaacatgatgagcagtgaaaaagaaaaattgctgcgtatggaagaagagatagggaaaacagtcattggtcaagaaagtgctattaaagcagtaagtgatgctgttagaagatcgcgtgcaggagtacaagatgccaataaaccattaggatcttttttattccttggacctactggagtaggaaaaacagaattagtaaaaacattagctgaatttttattttgtgataaatctgctttattgaggtttgatatgtctgagtttatggaaaagcatgctgtatctcggttaataggtgctcctccaggatatgtaggatatgatcaaggtggtatgttgactgaatctgtgaggaggagaccttatcaagttatactttttgatgaaatagagaaagcacatggagatatttttaatattttattgcaagtattagatgagggacggttaactgataaccatggtaaattggttgattttcgtaatacaatactggttttaacatcaaacttaggacaagaaatactgattaataataaggaagatgttgatggagagtcagtaaaaaaatctataactagtgtgttacaacatcattttcggccagaatttttaaacagattagatgaaattattgtatttcatagattaactaaggaacatatagagaaaattatagatgtacaattttctctgttacagaaaattgttgctcaaaaagagttagagattagtttatcttcggaggcaaaatcttggttgatgaataatggctatgattcgttatatggggcaagacctttgaaaagattaatacaacaaaaaatacaaaatagtttagcaaagttaatacttgcaaatcaagttagtaagggagataagctagaagtagttttgttgaatgacgatttaattattaataagttatagattaataataatattatcatatggaatttgctgaaagtatattgagtttcatttgtacaatagtgaaatgcttattgacctttgtagtagtgcataatagttattattaagacatacggataacaacttttgtgattatttataagacttatacggatttttatcctcaattgtaatgttaaagtaataagtttttatcccaagtgtatttttggtgtatcgtgctactagtaagtcttgtaaattgaagtctatgttttgaaattgattatcaattgaattgtcatattctgggaaaaacattgttgtattaaattcagaaaattctgaatgttgtaacaaaaaatgtatacgaggaactttgtttttcttgttaataccagggataatggttataaaactataatttcctaaattgtcagttactgattttcctgaaccaatgaactgataatcatacatatctaattcttctagaataagttctgatttgtgtttatcgtcttggctgtcttgatatattccatgtgcattggtgtgccagataaagacgttagcatttgctataggtatacaatttgtgttagtgactttgccgacaatatatatcagttctccatcagctgctaatgggctgctcatcttgcgtcgtaaattgtttgataaagaaaacttacttggtttattgttaaggtcaaagatttcaggagttttttggcagtgaacgagaattggatcaattgccaatgcatcgtatgtacatgttatacttatgagtaagcataacaatgattttgctaagtagttcatcttattaccataatttaaatctttaagtcataaacaagataactttttattatgatttaacttaatcttacgtagagatcatattacccataatagtttcttgttatagcatattataaatactaaatattgtaattcctaaaaaaacttttttgtgtgactatttgtaaactagattgtagtctatttaaagatatatttataatttttttgaatttgtataggtcatatttctattctgtatgagtcatattgtaaaaatatatggttttcatgataaatacaatatttaattctataaaattttattaaataattaattattattcacttaattttacttgaaaagtttctaaaaagagttaaagtaaaaattacatgtaaatgccaatttaggataaccatatgatagatatatcgttttcaagtttaatgccaggggtatctttgtttttaaagacaacagcaatagttgtgggtatctttgaaggtagtaatcacttggaagactatagtgccttagctgagcgtagtgagcaaattatgaaggtggtagaaggttacaagtcttttgatggtaagtttgcagaagtattgccaattactggattagatgcagggtatcctatagtaatagtagtagggttgggtaaacctgaagagtttgatgaaaacaaatctttaaggattggtggtgttatatattctgaacttaataggatgaaaatatcagaggcctcaattataagtagtaatgatagtgatattatggctaatgttgcctatggggcatttttacgcagttttaagtttgataaatattttgttcagaaaaaagatgaaaatgcaacttatgtgcgtaagttagagttcttttcaaaaactaatcctcaaaaaacagctgttttgtttgataatttaaaagccgaaggtgagtcagtatttttagctcgttcttttgtttcagaacctcctaatattctttatccagaaatttatgctcagatgatatatgaggaattaagtaaagtagatgttaaagttgaaatatttgatgaagattatatgaaagcaaatcagatgatggcacttctaggtgtaggacaaggtagtgctaagaaatctaggcttgtggttatgaggtggaatggaggaaaagaaacagacagtccgatagcatttgttggaaaaggagtgacgtttgatactggtggaatatctttaaaaccttctaggggtatgtgggatatgaaatatgatatggctggttctgcgtctgttgtaggtattatgcggactcttgcagcaagaaaagcaaaagttaatgctgtaggtgtagtagggttagttgaaaatgctgtaggaggaaatgcgcaaagaccaagtgatgttgtaacttcaatgtctgggcaaactattgaagtattgaatactgatgcagaaggtagactagttttggctgatgctttatggtatactcagaaaatgttttctccaaaattaatgatagatttagcaacattaactggtgcagtggttgtagcactaggaaataatcaatatggtgggattttttcaaacgatgatgcaattgccaatcaattaattgttgctggtaatgagtccggtgagaaattgtggagattacctttagatgatgcatatgataaacttatagattcttcgattgctgatgtgcaaaatatttcaacaaaagggtatggtgcagatagcattactgctgcacaatttttacagagatttgtaaataagactccttgggtgcatctggatattgctggaatggcgtgggataatgaaggtaatgaaatatgccctaaaggtgcaactgggtttggtgtaaggttactgaataggttgattttaaaatactatgaggctaattaaactattgtaatagtgttttgttaacaaatttatatagttatgattttataaagattctggagtactagtcaatttgggatataatatgatttattttacgatgctctttgtacatggttaatattatgggtaacttagttatatgacgccgcttaagttaggtattttaatttcaggaaggggttctaatatgcaagcattaattaatgcttgtgcacaggatgatttccctgcagaagtatcctgtgtgatttctaataaccctaaagcaaatggtttattgattgcacaaaaacaaaatattaagacttttgtagtacaaggtcgtccattggattttgattctattgatagtatacttagacaacatcaagtagatttaatatgccttgcagggtttatgagtattgtacctgagggctttattaataagtggtttcataaaattattaatatacatccttctcttttaccgtcttttaaaggattgaatgcacagtctcaagcattgaaagctggagttaaaattgcaggatgtactgtgcattatgtatatccagaagttgatggtggtcccattatcgtacaagcagcagttcctgttttttcatcggataatcttacagatctttccgagaggatattaaaaatggaacatatttgttatcctaaagctgtaaagttgattgcattgaatcagcttcaacttaatgaaaatttagccacatcagcggaattgttgcatatgttttatgatgaaactatttaattcttttatatgttacgtaaaatctgagtaaaaaatttgtttttatgtattctagtaagcttgtaaattatatatacgtgtggtaatacttttaagttatctgaaatttagtaagaatttttatttttgttagttctgaattttaatagaaaatttttaattgatttagcttactacatctgcatttttgtcgaagttatataatagttttggtctattattgagtgtatagtgttatgatgatttttttgatgtgtgattaagtctatgtcatatgatttaatagagtggaaaatagagtctctacaaatagattatcaagaggcaatatgctttatgcaacaaaggatagaggatatttataatggagtgcaaaaggaattagtttggttgcttgaacatcctccgttgtatactgctggtactggagctaaagttgaagatttactagttgataatttatttcctgtatatgctacaaatagaggtggtaaatatacttatcatggccctgggcaaaggattgcttatgttatgttgaatctgaaaaccagaaacaagtgtaatattagattatatgttgagactttaggcaattggattgttgaaactttaagtcatttttcagtcaagtcgtattttaatcctgacttgataggtgtatgggtaactcatggtggtactgaaaaaaaaattgctgcatttggaattaggataaggaagtgggtaacttatcatggagtatctataaatattgatacaaatctttctcattattcaggcatagtaccatgtggtattaaagattatggtattacttctcttaggaagttgggaattaatatctcttatgaagaatttgatattgtactacaagaaaagtttaatgaaattttttctaattttaattgaaagaacactgtaatatgttgaaattaagtggcatatactcttctatcttgtaatagcagcatttttaatgcaatcaatgtaaatttggagttggtaaatgctgaaaaatattttcatattggtgtagttacgttgggtgtgatgggccttttgtattgaaagtattatataaaaatttataactctgtataagttgatgatcatgtttaatatggggaatgattgaataagtggtgatagtgtttattaatgagtatttatgttgtgaatttgcttggtgagagtttttattagtactatatggaattctgtgaaaatttgttactttatgtaagctagtataatttttttaacgtaaaaagtaatgaaaagggtagtactaatttttacttataaatgctttaatattacaaattaacttgaaaatccttatgatttatgaaaacttatcacttgtgtaagttgataatcatattagtttaataagaataataaatacctgagtaagaagtattttagattatgatttctgctttgtaagtagttttgccagatactatagtccttaaaactttaccttttactttacggttgtgaaagggggaattttttgatttacttgcaaattttgatatgtcaactacccattcatgatctaaatccaatatgatgagatctgcaacatagtctttttttatacgccctcttggtacctttataatatcagctggcttgtatgttaatgttgctagtagatctattaaaggcatggtaccattatgatataattctaaagaaattggaagcattgtttctaatccaactattccaaaagcagctgtatctaatggtaattccttagcattgatatcatgaggagcatgatctgttgctatacaatctattatgccactttttaatccttctatcatactaaggcgatcattttcagttcgcaaaggaggattcatttttgcaagactaccatgtgtcattatgtctctttcagttaaagtgaaatgatgaggagttacttcacaagtaacttttagtccttgactttttgcttgttttattatgtgtaaagactcttgggatgagacatgtaaaatgtgataatgtacatttttgatatttttcattaaagcaatatcacgatttactattatagattctgaaatatcaggtataccttttaatcctaattcatatgatattattccttcattgatacatccgttattagatatgtttaggtcttctgcgtgttgtgctataacggtatccaacatacttgagtaacttagtgcttgtctcattgttaaagcgttcattactggcatgccatcatcagtaaaaccaactgctcctacttcttttaacagtgccatatcggataatgaattatctgattttgttatagaagcataaaactctatgttgacataagcactttctagagctctcattttaatgtattttgcagtgattacactactgatagtagggatagtattgggttggcaaactacagttgttatacctccagctgcagcagatttgcttcctgtattgatggtttctttatgctcttggcctggttctcggaaatgcacatgaatatcaattaaacctggtaacagtatgttattattgcaatctatgacctcatctatagtacttggtataccattagcaaatagatcaggtccaaaatcaataatcttatctcctttggtaagtagcgaacctctgatatctaacttagattctgggtcaatgattcttgcattaatatatgcaacggttaaatctgcatgttgcccattgcctaacaattcccaagattgtttatacatttttcaaatgcctaagaaagtatgaataaatgagtaactgatataaatacatctattataacactatctgtaaattgttttatagtcaatatttatgtataacatgtatagtattaaaaatcatatatacattcttttatgttattttatagttataatgcaatgttgatatttttttaaagctttgagttttaataaatcctttttgtatttactagttgtaatttgaaatttttttgaattgctagattatgatttagtattatttatcttagctaaaaaatttataatttcttctgtaattaattgacctatttcttttttagacattatagggaattctttataatgatctttagtaatgatagtaattttattatagtcatttcccataacgtgttcattgttaatggttgttgtattgctgataatccaatcgcattgttttcttttaagtttaatttttgcattttctatgacattttctgactctaatgagaatccaatgactagttttggcctcttttcatgagtacttatacaatgaataatatctgggttgttagtaactttaatatttgtaatttcatgtttttttatttttctgacagaatatgtagggcaccaatcagtaactgctgcagtgaaaattgcaatatctactggcagtaactctatgcaggtttgtagcatttcattgcagttttttacatgtaatatattttgtatattatgattatgaattgtaactggcccagatactaggtttactttccaaccaattttattcatatattctgctattgcgtacccttgttttccagatgcattattagagatatatctgataggatcgattgcttcttgtgttggtccagctgttattaatacattaaccataaagtattgaaatatttaaatttttattctagtacaaaattacagtaattcacaataatttcttcaacaactatgtatgcatatttactagattaactgttacaaacaacctgattgtacagttaatcctagaagaatatggaattgctgttgcggtagtataattgttgtgtactgggatattcattatatgcaattgtaaagttcaaatatttttaagtgattgtacatgttctatttttgagtgtgctgttatatgtttggttggacaattcgatttgtactgccttggttattattgatgttatgaaatgttagatagaattgatatgtaaaagtcttgtgatgcttatatagtgtagcactaatatagttgtgttagttatggtggacataaatacaaaactttattaatataatttatcacatgtaggtggaaaatttagaatatgagaaaggaaagagatagtttgggagagatagatgttcctgcatgccattactggggtgcacaaacacaacgttctattgataattttaagattggctcagagaaaatgcctaaacctttaataaaggcattaggacttgttaaattagctgcagctcgtgtcaatatgaaaaatggtgatattagtgaaacaataggtaatgcaatttgtaatgctgcaagtgaaattatagatggtaagtttgatgatgagttccctttagtaatttggcaaactggttctgggactcaaagtaatatgaatgttaatgaagtaatagcaaatcgtgcaattgaaatattaggtggagaaaaaggtagtaaatatcctgtccatccaaatgatcatgtgaattattctcaatcctctaatgatacttttccaacagcaatgcatattgcggctgttattgaaactgaaaattcattgttgccaaatttgaaaaatttatatgatgctctacatagtaagtctatagcgtttcaaaatattgttaaaattgggcgtactcaccttcaagatgctactccgttgactttagggcaggtattttctgggtatgcgtatcagattttacagggtatgagtagggtcaagtcagcgttaggtcatttacttgagctagctcaaggtggtactgcagtaggtactggtattaattctaggaaacagtttgatgtccattttgcaagtgaaataaaaaaattaacaggttttaattttgttgcttctgttaataaatttgaggcattagctacacatgatgcattggttgaatttagtggagctttaaatgtgcttgcagtaagtttaatgaaaatagctaatgatattaggttacttagttcaggtccaagatgtggaataggggaaattatattgcctactaatgaacctggatcttctataatgcctgggaaagtaaatcctacccagtgtgaagctgttactatggtgtgtgctcaagttatggggaatcatacaactgttactgttgcagggtcaaatggtcattttgagttgaatgtatttaaaccagtgattatttataatgttttacaatctattagattattgtctgacgttagcattaatttttctcacaagtgcgttcaggggataaaagctgatacaaatcgtatttcgtttttgttgagtcaatctttaatgttggtaacagcattaaacaaacatataggttatgataatgcggcaaaaattgcaaagactgcctttgatgagggaataacgttaaaaaatgctgcagttaagttgaatttaataagtgaagaggagtttgataaaatcgttaatccagaaaatatgatatatcctacaggttaaatattgtttaatacaacttgtttaataactaacagtgttgacagttaatacgtgttattataacatgaagtattatgttcttaatgaaaagtgattttatggcagaagacgattacaaaggtgtgataaagcaatatatagatacagtaaaagagattgtgggtgatagcaaaacctttgatcagatgtttgaatcggttgtaagaattcaagaaagagttatggcggcgaatgctcaaaataacgaggatggtgtcattgataatggagaccaggtaaaacgtataggatcttctacttctgaatctattagcaatactgagtataaggagctaatggaggaacttaaggtaattaaaaaacgtattttaagattagaacgtaaaatattaaaacctaaagaagaagtataagatttattgtagtatatgttttatatttttttttggtagttatttataggggttctttattacaataacctggtttttttattggtagctgtagtaaggggagagtaagttattcttgtgttattaagcagggtttttcagttgtttatttaatatttgttcctgtatgaaggctatcctttgttgattacctattaattgaaattatgtatagtcattgttactaagttataagtaattgagtggctttatgtagtattatcctaaagttggggaagtctacatatttgttaatgttcctgtagttttatatttataacaaagaagtaaatatatttatatctaatcttatttaattttacaatataagtttttaattcattgtatgtggccgtactgtcgatatttttataaagtatgaaatttgttgctcttttgatagtcggtgatattctgacaactcgttatttttttgtgtattcctgcatagattctacgtgaataccttgcttttttaatgtttttattgcaagtgctaaagctcttgcaccaggtattgtggtactatatggaattttttttatcagtgcagtttttcttatgctactactttctgaaaaggacttgataccttctgaagtattaattactagatttattttatcatcttgtaataagtctaatatatgtggtctaccttctcttactttatttacatgttctgtagtaatacctgcttcatttaaataagtggatgtgcctttagtcgagaatatagtaaaaccgatatcttttaatatttgtgctgttttcacaatgagtggtttatctgaatttttaacagatataaaggctgtacctttagttggtaattcgtaaccagcagccatttgtgcttttgcgaatgctatttcaaatgatttatcgattcccattacttctcctgtagacttcatttcaggtcctaataaaacatctatgtttggaaatcttgagaaagaaaatactgcttcctttacagctacatgtgtgagtttctcttcaagagcgttaggaagttttttacctagtaatacttctgttgcaatttttgctatagggatacctgtagcttttgcaataaaaggtacagttctgctagctctagggttaacttctaatatgtatatttcgccatcttgtattgcatattgtatattaataaatcctctgacttgtagtgcaagtgctattttttttgtctgctctgctatagcatctgttatttctgaggttaaactatatgaaggtaaagaacatgcagaatctcctgagtgtacaccagcttcttctatgtgctccattatccctgctatatataccttttctccatcacagatagcgtctacatctacttcaattgcatgagttaaaaattgatctaacaataatgatccatgatcgaatatgttcttataagtagttaagtaatttgataaagcattactatcacgaataattgacattgattgtccacctagtacgtacgatggtcttgctagtatagggaatactaaatctttgatgcattcatatacttcatgtattgaattgcaagtgatattagaaggttgctttaaatttaattgtgtaagcaattgttgaaatttcatgcgatcttcagctaaatctatggaatcaaaggatgttccaagaatattaatgtttttctcttgtaatacttttgcaagctttaaaggtgtttgtccaccaaattgtactattactcctaataaagagtttgtctcttgttctttatatatgatgtctagaacactttctcgtgttagaggagaaaaatataatttatctgaaatgtcgtaatcagttgaaacggtttccggattacaatttatcataatagactcataccccatttgtcttatggtatgtgctgcatgtacacatgtataatcaaattctataccttgaccaatacggttaggaccactgcctaaaattatcacttttttgttatttgttacaacagactcacattcagtgacattgatagtattaccttcatagcaactatacatatatgatgcattggttttaaattctcctgcacaagtatctatatgtttatatacaggttttatggataaagatttcctcagatcttctatatattctactgtagtcttgcttaaatatgctaaccttatatcagaaaaccccattttctttagtaataacaacccttctgcttcttttggtaatccatttttctgtatttgttgttcacattgtataatatttttgatttgggttaaaaaccaaggatcgtacccagtaattttattgatttcttctatgctaatattgtgtcgtaaagcatctgcaattataaatattctatctggagataattttacaagggagttatatagttggtctatttctatgttttggtcgaaatactcgtttaatccagaatatccagcttctaaggaacacagtgctttttgtaatgattctggaaaagatcttccaattgccattacttctcctacagatttcatggaggttgacagttctttttctgtacctcggaacttatcaaaattgaatcgtggaatttttgtaacaatgtaatctatgcttggttcaaatgatgctggaatgacttctgtacagtcattttgtatctcatctagagaataaccaatagctaattttgcggcaaccttagctataggataacctgttgcttttgatgctagtgctgatgatctagagactcttgggttcatctctataacgagtaaatcattgtcattttttgggtttactgcaaactgtacgtttgatccaccagtatctactcctatttctctaagtatagaaaatgatatgtctcgcattttttgatattctacatctcttaaagtcaatgcaggtgctactgttatactatctccagtgtgtactcccattggatcgagattttctatagaacaaactacaatgcagttatctttattatctcgcataacttccatttcaaattctttccacccgatgatggattcatctacttgtacctcagatattggggaaatgtttaaaccatggcttacatttttatgaaactcttctttattataggatataccaccccctatgccaccaagagtaaatgatggcctaattattgctggtaatcctatgtattctaatgcgtcatttatttcatcaacacttcttattattatactttttggatattttactcctattttgtccattgcttgtcggaatagattcctatcttcagcttttttaattgcttcttttgttgcacctattagttttacgttatatttttctaagattcctaactcacataggttgattgcagcgtttagagcagtttgcccacctactgttggtagtattgcgcttggtctttcttttataatgattttttcaataatgtttgatgtaattggttcaatgtatgttgaatcagcaatttcgggatcagtcattattgttgcagggtttgagttaatgaggataattcgatatccttcttgttttaaaactttacaagcttgtgtacctgaataatcaaattcacatgcttgtcctataactataggacctgctccaataactaatattgattctatgtctgtacgttttggcatgatgtatataaagaatttagctgttaatactataactattaatgcttcgtcttcaaaataaaaaaagtaaaaactaatgtttgataaggagttttacttatttttatatgatgtaaaatgagaatcattgataagcattaaactataatcggtactgcaattttcattatttatatgagtgctatgatactcaaagctttttcaaaataaaaaaagtcacaactaatatttaataaggaattttgcctatttttatataatgttaaatgacaatcattggtaagccttaaactataacagtactgcaatttttactgtttataaaggtgtcatgatgcttaaaactttaatggtacaagatattttatacctgctgtactgagtatgttcttggtatactgttgatatgaaatgtattattgaaagtagtaaattcttgattaggatgagaagtactatgattgtaaattggtgttatgtttatctctttttatgaggaaagtatagctaatgttataaatgaatagaatatattgaaaagctatgcttagtatgtgaatgttttgtacggtaggtatgaatttaatataatatgttttttagcatcctttgtgttaaaagtaatattgtcattttataacttcctgattattactgtattttttcagaatatgactagtgtaatattttaagttctcatattattaatacaatattaaatactaaattaaatatattaaaaaattattacaaataattaagaattagtaaactttatatgtttatgacatttatagaaaatgttatttttacaactcttagttgtatagtataaaaattattatactatactaatttaataataaataggtaagtaagatggctatgataataaagtttggggttgaaaatctgatcgatagtgctgtggaaatagtttgtaaatattttgatatatatcagcgaaatgatgcagtaaaacatgtattacataaatgtattaaaagtttaagaactgtagaaaagaaattaaagatatatagagggaaagaagctaaaggacatgtaattagtgatagccaatttgctgaaatggaggatctaataaaaaaagttctcatgaaggtgtttgagattgatatttcttatcaaaaacaacacttgtctgcagaaaaaatggaggagtataaagtagctgttagtcttttattggatcaaatagtaaggtgtaagtcttatgctcttaaagaaagtgatattcttcctaaggttgtagggaatgcaaccttaaaacgtagtgcatataagtgtaagcatgtagtggattttattaataagaatagatttcttcctatgaatatggggagatttgataagctttgttttgatctagatttagatcctcagattttgaaacaagttatagatttatgcagttttgctcttatatttgaaattttggatcttaagttagtacaatttcttgttgaaatgagattctttccacatcaaaacactaatgtaattagtataactaaagataattacatagaattaatgcagcatattatgctttataaatgttctcagtctattggcaaagagtatactaatgagcaagcaaggtacttaccttgtttttcacctggttatactcggggtaatgttaagggcaattcattcatatgtttaggaatagctttgtttatagcacaagctctatttaatggatttgggttattatttatgttgctgtctgaatttaagacacaaaatgattggtggtttattggcatatgtgttgttaatatgctcttagccgttactgctcttacgttgatttgtattggaaagaaacaactgagtcaaaatcatgataccttattaacggatatagatgtcagtggtattaatattgttgaagaaagtgtagatttatagttttttatttgtatgtcatttgtattagatatagctgataaaaatgcaatttatattgtaacatgattattaagtttgatgatttattttattataacaacaagttatatgtctgtatgtctttcattttatatttctctgattatataatatcaaccagttaacaatgtgctctgtatcaattgcttgtcgatatgtttataaaatatcagagtgctttttttctattactgcaagcaatcgttgtgtaggtttttataagtctacttttgatgttattttacttaacttattatggaaatttctgttgtctataaagaatcatgtatgtctttttacttctttgtttaattctaaatgattttattatgtattgaacattatgtgttcttaaatctatattcttaaataaatgtgttatcaatatagcatatattatcagtagatttattgtattatcaaatagaaagcttaattatagaatttttaaatttaaatattatttaggtgtgtttgatgcatttttctaagtaagttgaatgcttcgctatgtaagtgagtgttatgtaccctaataaagtctataccttgttgaaatagaaagattgatattgctagtgtagcattgtcacgtgttggatcatttgatgtgtatgaagtaagaaagaattttcgtgagtgtccaacatatattttttgatttaaaacttttaatctatcgatattgtttaatatataaaatgtttgattggcggttttactaaatcctatacctggatcaataatgattctgtttttatcaattcctgcatttgttagtttatcaatgtacttctttgcccatataataatttcattaattggatcaaggttttttggaatagtattgtttttaattaatggtatacctagactatgggtaattacaacatttacagaactattttgtagcacctgaagcatgttcttgtctgataatgtacttacatcgtttacataatctacatttaattctatagctttttcagcagtttttgcatatctagtgtctatgctgacttgaacattatgattatgagctatttctattattttaggcagtatatactttaatctatcccattcttctgtttgagatattgtattgttcccatgttgtgtatataggtatgtaggccttgttgattctcctcctacatctattatatctgctccaccgttgattaagtgcttaacttgttgtaatgctttatctatactgaaaaattgcccgccatctgaaaatgagtcaggagtataatttaatatgccaactagtttcgtattgaatttcatgagatctatctgaaaaataatgctatgagtattaatgatataaattgcaatagtactctaattatcattattttatttctatgtttaatgtagaattcattacttatcgccattaacactactccagatatcaaagatattagtgttaatgacacgaaaactgaaattactattaacgatgttgtattactaaacatttttacacaatataaaaatacactgcattatatcataatagtataactttatctcagtaaaaaattatttatgtgaaaatttattaaatatctgtattgtttgcttagatgaacgtattgtaatatgtgtataatatattaattatttagagggatatgtggaaggagtaaattttaactttcaaacaatgaaggaactgaaacagagtgttttgtacacaagtttagaaaagtgtaaaagtgtcttttggtttattttctggtttagttctgctattaatttgcttatgttgtttttaccactatatacttctcaggtattagatagagtactttcaagtggtagtgtttctaccttaattatgttaagtgttattactgttggtgcttttgcttgttcttctatattggaaatttgtagatctttagttatggctaaagttggtgattggatagataaggttgttacccctgatcttattatgaaatctattagcttaacttcggtgaagtcatctacttcaagtggggaagtacttcgtgatttagctgttgttaaaaactttattactggatttggtatattttcactgtttgatactccatgggcggtgttatatctagttactatttttatgatacacagtgtgacaggttatattgctgtggtaggaatagtgttattaactggtatggctatttggaatgaattagcaacaaaaaagatattgcaagaagcgagtgaggaaggggtacgtaatattcactcaatagatgttgcaactcgtaatgctgaagtagttgaagcgatgggaatggttaactatattgtggatgattgggcagataggaatgatagaaatagagagatgcaaataaaagcacaaaatcgttcaaatttaatttctgggattactaaatttattagatcaatattacaaatatcagttataggtattggaggatttcttgcaattcttggtcataaaactgctgggggtattattgcttcatcaatcttaatgggaagagcattagctccatttgaagcattgattaatacttggaaaatgttaatatcagctcgcatatcttataaaagattgcagatattacttttagcttctccgaagagagaacagagcatgtctttaccagctccttctggaagggttgtatttgatcgtgtcttctttactccttatggtagcaataaaccgactattaagggtgtatctttttcaatggaggttggggatatcgttggtgttatagggcatagtgcgtctgggaagtccacaatagcaaagttattggtaggagtatggaaaccgatatcaggtgttgttagacttgatggtgcagatgtttatacgtggaatagagaagattttggacgttatattggttaccttccacaagatgttgagttgtttaatgcttcggtaaaagttaatattgcaaggatgatgccagatcctgatcctaatgaagttgtaaaagctgctaaaattgctggtgtacatgagttaatacttagcttaccaaatgggtatgatacagttattggttctaatggagtagtattatctggaggacaaaaacaaatgctagggttggcaagggcattttatggtaatgtaaagcttttagttctcgatgaaccgaatgctaatttggatggaaaatcagaggcaaatttgattaatgcattactttatgcaagaaagaatggtattactacttttattatgactcataaaatacagttacttaatgctgttgataaggttatagtgatggctgatggtatggttagtggtgttggtgctagagatgaaattttaagtaaagttgttcctaattatactccatcaaattctcagcctaaacagcagaccaagccgttagtagagtcagaaaatacatagtatataagtacctatatattgttctgatttatagaggatatagtatttataaataagttttcaaggaagatgaattatatattactggaatctcaccaatacaaaataaatcttagtatagtataattcgcagtacagattatacatgtaagaaaaaatttattgatttacaaccaataatacaagaaaaggcagaagttttatatcttgatgaataatcccattattttatggtaaataccattataattttcatcattaccaatataaattgatgtaacaatgcatattaattttaatatacactaaaacaagtttaaattttttactatttctataatcatatgctattacaaacccagtacaaactatgtattgtccaagtacaaaaaacatcaatttttaaagagataacgtaagtaataatgttttagtatacacattatcagtaatatttccacacaacacacattaaaaccaactttttataggaaaaaacacccatttcttgaccgtattgtttccctatataatcctcagctagaaagtagcaaattacatattcactgaattaatcacacactataacttttcttacatagtaaataggaaaaatgcatgttatatacttaacagtaagagaaactttgaaatattgactgctgtaattattttaattatgtgatcttgatttatcatggtagtttgttggattttagttaaagttagttgtcaagataagagattgtgttgttacgtttaaaaaatttgtggtggttttgatgatatttttattattatgctaattttacaatatatgtactaaagtataatgctgtttgttattaattaatattgatgtcttaaattaaaaagatatcatttagctgtttgataagtattctaaatgtaattacgttctatttaattatgtgatgttatggtaaaagttattattattgataaaactggtagtgctgaagttttaaaatatgttaatcataatattggtgaacctaaagatgatgaggtattgataaaacatacagctattggcttaaatcgctacgatcttgagtgccgtaatggtatgcgtaaaaataaaaaacttcctgctgttttaggagttgaggcagtaggtgttatagagagattgggtaaagatgttgaagtgtttaatattggtgatagagtaggttattgtactgtatctggaggggcttattctgaaaaaagacttattaaacaaaaatatttagttagaatacctgatgatattactgatcaagtagcagctgcggtattatttaaaggtatgacagcgcattatcttacacacttagtttatgctatacgtcctaatacttttgctttagtgcatggagcaacaggtggtgtaggccaaatattatgtcagtgggctagttataaaggatgtaaagttataggtgtaattagttctgatgatagggctaatattgccttgcgtgctggatgttcatatgtagtaaataataatagtaaaaattttgttgagcagatcatggaaattactcacggttctggagttaatgtagtttatgactgtataggtgatttagctagtaaagtatcttttgaatctctttgtatgtttggtatttatgtttcttatggccagatatcaggacctatttcaaatgttagtgcttctatgctaagttccagatcattgttttttacctctcctttggtgttccactataaacgttctagttttgatttggcgatgacagctatggagctttttgaagtgataagaagaaattatataaaagttgggataaataagatttataagtttggtgatatagtaactgcacatcaggatttggaaaatagaaaacttactggttcaaatattattgaactgtagatgttttataagtgagcaaaaagatattttacctttttactatgataagaaaagttatagtgcgtgattaattcagtgaatatgtaatttgctactttctagctgaggattatatagggaaacaatacggtcaagaaatgggtgttttttcctataaaaagttggttttaatgtgtgttgtgtggaaatattactgataatgtgtatactaaaacattattacttacgttatctctttaaaaattgatgttttttgtacttggacaatacatagtttgtactgggtttgtaatagcatatgattatagaaatagtaaaaaatttaaacttgttttagtgtatattaaaattaatatgcattgttacatcaatttatattggtaatgatgaaaattataatggtatttaccataaaataatgggattattcatcaagatataaaacttctgccttttcttgtatcattggttgtaaatcaataaattttttcttacatgtataatctgtattgcgaattatactataccaagatttattttgtattggtgagattccagtaatatataattcatcttctgctctagtcatggctacataaagcaatcttaaatattcattgtattcattagtcttttgttgagattttagattttcacagaaatcattgatatcattgcgtatccaaaatggagtatactcctcatcaaatactaattgggtatcactttttggaatggtggttgtatctgataggaatactataggagattgcatgccttttgcgttatgtactgtcatgatttttacataatcttttgtaagattgatatcactttttatttctgggttagtattttttatccagtgtataaatgcttgtaatgaattgatattgtgggattcgcattgtattaatagattaatgaactctcctatgattttagtgtttgattgacctaaccgctttgtgaatttgtgcttgtgctctgatataatatggtgatacagatttaaaggactatggagttgtgatacgctaatcagttgttttaggtaatttgatatagtactgaattttgattgtaattcttcccataaatatgtgttatttctgttgtatgctaaatcaaaaatttgtttttcattgaattcaaaaattggtgattttaataaacctgttaatgctaagtcattttctggtaatagtaggaattctcctaaatttacaagatcttgtattattgtgtaatccattattttaaacttatctctttccaatgttggaatatcgagtttttttagtgaagttataacgtgatctataaaacaagttctatgtctaactaatattaaaaaatcacctgctgttataggacgattttttgctaatagaattcttttattaattatccatgaatgaattttattagcaatggttgatgcaagcaataggttggtatctaaatcagtacgattttcgaaatccaatgaaaagtttttattatttttaatatcaattatgggccatatttctacgtatcctggatcgttttttcgaaagatttcatgctctatttttgttgtactaaaagatatttcttggcaaaaattattaaatactttatctactaattttaaaatgggtggtgttgatctaaatgattgtgtgagatgtaatactttatgtttatattgtgtactttgttgtgtaaagtaatgacacataggattaaagtaatcaggtcttgcattttgaaaaccatatattgactgttttatgtctcctacgatgaatagagttcttagttcttctgtcgtacctataccagaaaagaattcatgacatagttgtaaaataatactccattgttttatactattatcttgtgattcgtcaatgagtatatgatctattttactgtctaagtgaaataatatccaatctttatatgttggattttttagtaagtttaacgctaggtctataatgtcattatgatctaaatagtttagtttttgtttatcttgttggtatagcttagtaaagcattttgcaatttcaataagatggatagtgcgttctgctattttattagtatgaaaggtttttataaagtttagtatttcttcttgtatatctgaaacaattttctctatttcaggagaattagttaacgttttttttgtaattattgatgatatagattttttttctagggatggtaaattgataaatatttttacgtacttatttaatttttgtagtttatatttttgtgataaattgctccacttaactaagttctcactaatttttttatcccttatacttccttcacttagaattttcgttaaatgattcagtgtgttgttatcagtggggaataattggtatgtttctgtattattaatattattaatgttgagttttttatatattgaattttgattgaagttgtaatgctgtttatttaataacttgtataataaatcatagattgtagcttctgttatttcatgtgaaatagctgataaatgatgttttgttgttggatcatgtaataatttatgaaaaatttttgtaaaggattctgagaaatctttaatactacagtcaggagcaattcctgtttctatgggaaaagtagatattaattgataacaaaagctatgtatggtttttattgaaagtgatacattttgtaaattgttgaataattcccttgctcttttgtattcttttggagttatattagttggaataatgtcttttaatgctttttttaattcttcattttttaatattgcccaagtgcttatgatagaatgtattctctctgtcatttcatgtgctgctgtatttgtaaatgtcaagcaaagtatatttttatggcctgtaactaataatcttaggaccctgttgactaatatttttgttttgcctgttccagctgatgcagatatccatataaacgagtaaaaaggattagttgcaatgttgttcatttgatgtataatccacaatatttctatttttaatgttaataaaaaattatattaataacagtaattattgttgtaaaagattttattagttaagagagtctttgatgaaaaggttgtttctatttgtgatgataataagttttatcaatgcaacagttggatttgctcgtagtttacgtgctgatggtaatgtttatactgctgggataggagatgttgatgaagatgaatcttcagataatggtgaacaatatgatgaagatggggaatatgatttagatgatatttattatgaagatgaaataattgatattcaggaaaacgtagatgatgccatttatactgctagaatggaagatatagaggattcttatgaggaagaattcttggatgatgatgaacaatatgatctagatgatatttattatgaagatgagataattgatattcaggaaaacgtagatggtgctatttatactgctagaatggaagatatagaggattcttatgaggaagaattcttggatgatgatgaacaatatgatctagatgatatttattatgaagatgagataattgatattcaggaaaacgtagatggtgctatttatactgctagaatggaagatatagaggattcttatgaggaagaattctcggatgaagatgagcagtatgatgacaatgaacaatatgatccggatgaggaagaagaggattatgatgatattttgtatgaggaagatgattatggtcaggtagatggtgatgaactgcttgatgatgaaagtctcgatgaaggtaaaaatgtattcctagaggaatatgatgtacctcagtatggtcaagatgttgctgaccaaaatcaagaagtagatgataagactttactcaagtctggtaatgcaaaagatcagcagttaaaagctccagataagaatgctacaaatgaaactgatggtaaaaaaaaactcctgaagtattaaaagatgcatttcaagtacaaaataaagtggaaaaaagtaatgtttcatacaaatggccgtttacaagaaatgttatagaagagattgaaagatcgaaatatgatgaaatgaatgaacatcttccaaaaatatatactgttgaggattattacatacaaattttttactgtataatgcaaagtgatgtttctggattgagatctttaattaataaattgcaagaattaggtgtaagtttatcaactatactatatgaagtacggactttagatgttggagataatttattaacttatgctgtaaaacaaaaaaaattggatatagtgaggttcctattatcaataggtgctaattcaaatgttgcaaattataataatgaaactcctttaagtatatctatagaaaatggtagtatggacatagctcatgctatacttgttgcgcagtaaaagttttctacataagttgttacagacattaatatatgctgtatgtttcgatcttaattatgtaggttttttataatgtttaacagtttttggaattttataattcaatttgatgatgtgctagtttaacgtcattaattttacttagttaatttgatatacataagtgtactatgttgatgtttttatgtatcatcaatatttactggattattgaaagcaatattcaatgcttatgggaggcgtattgtgaatagtaaagaattttgtgataagaaattagtgcacattaatggattttcaatgatattttggtgtattgtttttattttgttgttgttgtctggtatatactatggaaatttttttattgtgttaccaatgtctctagtgtcgttaatttgtacatttattattccaagtggattttttgtgaataatcctaatgaagcaaaagttgttgaattttttggaaattatattgggactatatttaagtcaggttttttttggactattccctttgttcgcatgaggtcaatttcattaaaggtgagaaatgttaatacaagtaagatcaaagtaaatgattttaatggtaatccaatagagatagctgcagtagttgtgtggcgagttgtgagtcctgcaaaagcttgtcttaatgtgagtgattatcaagagtttattaatattcaaaatgaagctgcggttagggaattagctggtagctatccatatgatgctgaagataatagtgaatctttacgtaataattcgacaaagatctcgtctaagttacgtgatatgttacagaatagattagatttggtaggtgttattgtagaggatgcacgaatatcacatttagcttactcttctgagatagctcaaattatgttaagaaggcagcaagcaaaagctattactaatgctagaggatatatagtaagaaatgcaatcattatggtagacgagatattaaagcattttgaattgcaatatcaaattaatctttctgatgagcaaaaagttaaacttgtgaataaccttttagtatctttaatctcagagcaaggaactcaacctactattaatatagaataatatgtattagtatattttcaataagactcaatgtgtgtaatgcattttaaatagtttataatcctgaacaagtttacataaatactatatcattttttgtaatgttgctaaaaatgtgatcagctttaaagcgtatatgttatataatttgtaatgcaagagtcctgttatttattatgcagaaaatttaagtagtatatgtattactaataattttattaataagatttttcttcatatgagtacttaattttgtgtttcaaaatagttactttagaatctgtgactaatctcagtgtattagaatagtgtttagatatataaaagatatttcatagaaataacacatgtaaatgatttatccaactcttgctttttatttctcctaagttttgaataaaaatattttaacaagataggttaattatgaattatgatacattaaatttttatgaatattatgatacatgtgatgtggattgtgcagattatgtatgtagtaatggagtgttagaggaacatatatcttatcagtcaatgtggaaagcagttatacttcaagcaataattgattcgacatctaattatagaaggatggaaaataagcttgagaaaataaaagctactaattggcttaatgacttttcgagagattttataactgtttgtcattttgcgggatataatcctttaagtgtccgaaataaagcaaagagaattatctcagataataaaattttaaatgaggataaaattagaggttagataaactaaatctcaactgtataacttttaattttgctgttaaataatctgcaagttgagatttttaatttatatgagtattagtgatagtaattaatatttgttatatattggttttttaccattttattgattaagtttatgataaaaaagggtttattttttcaaagttctaagttaatgattactatgttatatcatatatggaaatctcaacttgtataacttttaattttgctgttgaataatctgaaagttaagatttgtaatttatgtaagtactagtaatagtatatattgctttttatcattctattggttaagtttactctaaaaaagagtttatttttgtcaacgtgctaagttaatgattattatgttatatcgtacatggaaatctcaacttgtataacttttaattttgctgttaaataatctgcaagttgagattttattttattctaaatatagaatgaagtattgaaagtaataaatgtggttttttatataaattttcttaaaaagtgtgctaatgttttatgaataatgaaaaaaatgaaagaaatttttgatcactattattctatggtggatagtggtaaaatcacttatgatgagcagcaagttaagctattaaacgaattaacaccatatttatctgttgagaaaatttgttgctttttgcctataaaaaagagactacagaaggttggggtatacatatatggagaagtaggcagagggaagtctatgattacagatatatattataatgcttgtaaaatagaaaggaagaaacgacaacatttcaatcagtttatgaagacagtgcatactttattacatgagtttaaatcatctcgtgtcaaagatccactgcataaagttgctaaaacaatggttcatggtgtagatttattatgtctagatgaaatacaggtatatgatatttgtgatgctatgatattgggtcgattattttctattatttttgatcagaaagttattgttatgatgacttcaaattatgctcctgtagatctgtatcaggatggtattcaaaggcaatcttttgaatctacaatatcattaataattgagagaatgtgtgttgtacatttatctggtaaacaagactatcgggctattaaggatttagggataagtgatatatattttataggagatgattcttatataaagttatctcaattgttttttgaaatggcaaatggtaggagggtagaacctgtaacattacatgtttgtaggagaaatattaaagtgaataaaacttttgataatgttgcatggtttgattttgatgagttatgtggaaaagcattatgggtatcagattatcaggaaatagtacgtaatttttcagtaatatttattgcaaatattcctgtgtttaatcattataatcaaaatgagatgcgtagatttactattttaatagatgaattatatgaaaacaaagttaaaattttttgttctcttgctgtagagcctaagttgttatattacttgcaagaggtacctgtggattttcaacgtactatttcgcgtttaatggaaatgcggtcaccatcttactataatatttaagttgttataaattatgttttttattgttagaaatacttagcattgtttagtaagcatttatgtagattgataaataagatcatttttattatgttgtttaaatgtcctggtgatttattatatagtttttgctaacaggagtaattaaaatttaaaaatatattttaatgaaaataggacatggattttgttatgtccttgtatatagtctcttttaagcatctaattatgatggttactgctgttatcttttgtattactttggtatttgtttataacttgcttacaaggagtaatgtaaagcttcaaaacacattttacattgaacagagcatatattttttgatgtgcttgtgtgtacatttcttttaagaatctgattatgatggtaactactgttatcttttgatattactttttagtatttgtttataacttgcttacaaggagtaatgtaaagcttcaaaacacattttacattgaaaagggcatatattttttgatgtgcttgtgtgtacatttcttttaagaatctgattatgatggtaactactgttatcttttgatattactttttagtatttgtttataacttgcttacaaggagtaatgtaaagcttcaaaacacattttacattgaaaagggcatatattttttgatgtgcttgtgtgtacatttcttttaagaatctgattatgatggtaactactgttatcttttgatattactttttagtatttgtttataacttgcttacaaggagtaatgtaaagcttcaaaacacattttacattgaacagagtatatgttttgtgatggtttgtgtgcatatttcttgtaagaatctaattgtgatggtaactactgttatcttttgatattgctttttagtatttgtttataactttgcttacgaggaataatgtaaagtttcaaaacacattttacattgcacagggcatgtatttttgtgatgtgcttgtgtgcacatttcctgtaagcacttgatgtaatattcattgttgcttaatgtaggtactctgaagaacatattttcttttgatatgattttcttgcactctatatctaattctactagagtttcagaattttctgatacaaacgatataggaactaatactataggtacatcatcttgttttgcttgattaattgctgatattgtactgggttctaaccattttatgttgccaactttgctttgataacatattttataatctaatgatgatatatttaaagacttggtaattaataatacggtttgttctatttgatgttggtatgggtcacctcgttgtactatactcagtggtaaactatgtgctgaaaataatattcttggtgatccataattttgtgcttcccggtatttttctataattaactggcagtgtgcttttatataattttcattattataatagcaacaaatcgttgaagtagggcagtgaaatctactttttttcatgtgatagttccagtgttggatagctgatagtgtggtggttgttgagtaatgtggatataaaggtattagaattattttgtctggacgatactgacatacagattttattgtgcttttagctgaaggttttgaatgtcgcatgaatataaaaactttgtattggttttcattgtgattatttaatatgtgttcaagagatgaagcttgtatttttgtttcgcttaatattggtgactgtccattaagatgtttatatatttctattgcttttctctttctgaagaatgaaagtaatgttgccaatataaaccttagaggatttgatatgtttataatatttttatcataaaacaaattgaataggaacggccttacttcacatagtgactgaggaccacctaaattaaataatactactgctactttttttgacacgtattgtttgttcattatgagctaacaaaataacacatgtaatgctaattatcaagaagaaagaacagtatagctttatattatttatgttgtgaagaagatgtactttgagatacaggctgttctacaaaaaggtttacactactctcatttgttgtttctagtaatccttcatgttcagagctgtcacttgatcttcttaaaagtgttgatacagatctacatctaggttgtttagatgttattgtcaatagctcgtcaaggtatgaaataggggattttgaagtaccatcttcctgttttattattttagcgtttaatatcccaaaactacatgttacgattaaatctctacttcctgcatataataaactagctatgttctcaagatttgctttagaatgtgaaaactttttttccatttgagaatgtgttagtgtgttatacaggagaatgcataaatcaagtaagaaactaaatgggagttctaatatttctatgatgcaaagaatgaattctgcagctgcttttattcctattaaaggagtcattagcatagaaaaaaggatagtttttatagtacatgctgcaatgttagtagattctacaaaacttccttcaagcttattgatagacccaggtcgtttaaagttaataaaatcattgttatgtaaattagggtttctatatattggatgttttatcggaccacaacaatcttttcttatacttagtattcttaaagttagacaaatcattatcataagataatacatgcagctaagcatatcaggtgcatttgtaatgggtttagtgttggaaatattttatttccaaaataatgtgttgcgagaaataatgtaggcattacaagcatggcttcaaaaaatgggattaagtgctttcttatttgatgttttgcattctctttattatctgtaaccactgttctttggaaatttgtcatgtgtttactataatgcatctcataaagtgacatttccaatagactaatggctgccagattaaaagttgtccatccctttaatccacaaaataatgagttttttaatttaatatgaaaatttgaaaagtttaattttgctgtatgcacggtaatgtttcctgttgataaaatactattatattatactttatttattgtagtagtatattaatatatttgttatcctgtattttctatcattaatagcatacatgaacccccaatgctatttggagtatgtagtgataataagattgtattaatacctaaagaactaaattgctatatttaaaaaatgataaatgaagtaatagtacatatcctaagatttttctaaattatgaattaatttttctattcttaataatgtatgtgataatatattacttacttcgttttttatttttaaataatcatcaaagtattttttatacgttaacatttcatcttttgttttttttaattgagtcttcagttcgtgtttctcatcttctagtgttaatcctgctagtaaaaatattaaagcatcagaccctttgcctttttctgcacttgatattgagttaactaatgcattgaatttatctactaaattgcgtaagtgtggttcttctgttttattacatgctactctgtatgtgttatttctgacagtaatttcaataacttgtgggttagagttattcacttacttgctcctttttaaaatagctttgatattttctattgtagaatttaaacgatgaatagtttcatgacatatttctttccaactgttacattcatttgttttgtttgtaagttgttgatctaacttatttttttcttcagtaagtaattctatagttgctttatattgggatatattatttttattgtttagtttttgtattaataaagactctaatctgtcaaatgctttgtctaaattctgttggaattctgaattgttatttatttgattcataataaaccacattctaataagtctatatttagtttggttataacttattgatttataatcttaataaatttactactagctctaaagtatactttcttatacttactttttgctaaccttgcattagcagtttttatattataactccttactgtaaatgatccaaaacctcttaattctaccctacaatcattctttaaataatctacaattaatgaaaagaatatatttaatatcttagatactatctcttcactaagagaaggatttttttttgatatgtgctgaattaaatgtgattttaacatgatatttatttattaatataataatgaacaacctgagatataaatgaacttacattttcaattatagatttgtgttttttttttgataatactttgactttctgtgtgctaatattttgtgagtggaaccaattcattgcttcatcttgtccaccgatctgatcaactaaccctatagataatgcttcagaccctgtatatatactgccatttgctatctttaatacctggtccttttccatttttctgcggtctgctactatatcaacaaagtaatcatatgagtttttaataatacgacgtatagattcttctttttcttctgttaactcttcaaaaggagatgtttctgcttttagatttgaggattttattgattttaaagagatacccattttttctgctaaagggttaataccaatgtattgcattaacacaccaattgatccagtaatagtggtatgacgcgctattatataatctgcagcgattgcagtcatgtatccacctgatgcagcaaaatcatttaacagtgcgactactggcttattttttgaaacattacgtatattttgatataaaatttcactgcctgtaactgaacctcctggactgttaatatttaatatcaaccctgtaacatgattgtcttcggcaatctttttcagtaatgcatccatttcttcgtttgtttcaatttttccttcaatattcactttagcaatatattcattgtctaaaaaactactaatctttgatatgtcaatatagttaactaacattaacaatacgaatatcataaaaaatgcaaaaacccgccataactttactttagaatttaatacttctatttttagtaattgatcagacatgagataaacctattcagtgctttaatgatagtatcatattataagtttcaataagcaatacttcagcttctaacctatctcctgggaagaattttttattatcaggtaggtattcttgttcaattagtaagttgaaactatttgatccattgaatacatcaactaatataccagtatcttcaacaactttggtaactgtaactggtattttatctcctaagttaattttctttaataaatcaagaaaagggtcatactctagttgttttactccaagatctatcttgcttttatttggatttatcatgagtatttttgcttctacagaatctccaacgttatatttttttattgctgcttctggtgataaggaccaacttaactctgtagtacgaattaacccttcaatgccatcattgagtgtgttatcctgaaatgaaacaaatataccaagatttgtaatattttttatctttgttgatacaatagaacctaaaggatactttagtgtaaacgcctgccatgggttatcttgacaccttttcatactaagactcatgcgacttttagctgtgtctatgcttaataccttaacttgaatttcttcacctctcataaataactggtttataggaagagaattttttgtccagcttacttcggatacgtgtactaacccctctatccctgtttctaattcaacaaagaccccatattcctcaatgcttgtgacaatacctttatggatactatcaacaggatattttttctcaatatttgaccatggactttcctctaattgctttacaccaagagaaattttcttattttcacggtcaatttttataatttttgttttgacagtttggccacatgagaaaacagctgaaggatgacttacacggctccatgatatatcagttatatgcaatagcccgtcaactacacctactgaaggagattcatgtatttctatgaatacaccatatttagttatgcttttaactttaccttcaataatatctccttcatttaattggctgagatataaacttttagcatctgcaagtgattcttctaatatagcttttcttgagactacaatattaccttgctttttatccatctttaatatacggaacttttgctttttacctaataggggagtgatgtctttaacttgtcttagagctacatggcttgctggtaaaaatgccacaacaccttttatgtctacagtgtacccacatttaattgagctaaatattactccttcaacatcttcttttttttctgcagcttcttcaagtttctgccatagttcatctctgatagctttttctctacttaatactacactaccattacgaccttcgattttctctaagtatagctttacttttgatcctatactaatattctgataatcatcaccaagctcaaattctttaagtgaaacaatactttcggattttaatcctgagtctattgttacataccccttatctatgcatataatagtgccctctattatttgtccttctttgacactgtcatcaataaattcttttaacgcatgctgaaactctgagctactatcattatcggaatcttctacttcaagattatggctaataaacttgttggattttattttctttatattatgtaaataattttctgatcctaaatttgtttttgtttgaaggtcttccataaaatatagcctattttaaaattagcaaaagcggtaaaaatcatattattattatttaccatactttacaagtaggtttttattttttctttaatgtataaaagtacctgttctttattcatgtatgaagtgttaatgtatagggcatcttttacttttaccaaaggagaaaattttctataggtatctctaatatccctttctagtatttgtttgtgtatttttttatacatttctttcttgtgatataacatttctttaaaccttcgctgtgctctaatagatgcttgtgctgtaataaaaattttaaggtctgcttcaggaaatactgtagaagatgtatctctgccatctaggattatacctggttctgctagatggataagtttgcgctgtataggtaataatgcaagtctaatgtgttgatatcttgctaaaattgaagcagttttgcctatgtcttcattattgtatatagtattattatcttctaagagcagtgataatattttgtcctctaatttattgtcaatttttagatggttttgtgctgatgttccaaatattgtagctattatcctgtataattttcctgtatctaaatactgaaagttaagaaaatttgctaatttttttgctaaacttccttttcctgaagcagaaggaccatcaattgttataacgaaattattgcaatgcttggtcataattttgtataaaaatggaatatagtgctacagctgctgcgtttgatacgtttaagctatcaattttttttgatattgcaatttttagtaaaaagtcgcaattttcttttgttagtttacgcatccctttatcttctgatccaaagataattagttttttgctgtccaattttgttttgtgtagaaattctccttcttttgcatcaaatccatagcaccaatatcctgcttttttgagtaactttattgtgttgacgatgttgatcacatatacaatgggaatcatatcgacagcgccacttgaagtttttgacataccacagttttcagatggtgaattgtggtaaggtaatataattgcatccacattgaaacacacagctgatctaataatggatcctacgttatgaatatctgtaacttgatctaaaagtattattgttgaactttctttggatgtatttaatacctcttctactgttgttgaatcaataactgaggcttttaaagcaataccctgatgattgctgttatgtggtaatactgaattgatataattaggattaacttgttttaagtttatattcttttgtttgcataatcttaaaattttggatatttcattattatttttcataaaattttctgttaccagaagttcatgacattttctatttttattctgtaaagcagcggtacatgggtgtttaccgtaaatccatatcttgtttttgtccataaaaatgtgactattaattttgactttttttaattaggtattgacatattgtaatctttaatttagttaaatcaattctaatctaaatttttttggtatcattttttgtttttttgtgttaattaatacaaggatgttaggttagcgttagtgtttttaggaggagtggccgagcggtcaaaggcagcagactgtaaatctgcccactagcgtgtacgtaggttcaaatcctacctcctccacgggagattatgcgggtatagctcaatggtagagtcccagccttccaagctggctacgtgggttcgattcccactatccgctctttatttttgaaatggtttaatgatgttaaaggtatttgtttatggtagaagaaaggaaaccacatataaatgtagggacaatagggcatgttgatcatggtaagacaacattaacagcagcgttaacaacagtgttagcgaagaggttgagtggagaaggtaataaaagtgtaaagtatgacgaaatagataaagcaccagaagagaaagcaagaggaataaccatttcaacagcacatgtagaatatgaaacagagaatagacattatgcgcatgtagattgtccaggacatgctgattatataaaaaatatgataacaggtgctgcacaaatggatgcagcaatattagtagtatctgcaacagatggagcaatgccacaaacaagagaacatatactattagcaaaacaagttggagtaaaagatatagtagtatggatgaataagtgtgatgttgtagatgatgaagaaatgttgtcattagttgagatggaaataagagaattattatcaaaatatggatatccaggagatgatatagatgttgtaagaggatctgcagttaaggcattggaagaagaaacaggttcaggagtctggagtgaaaaaataatggaattgatgaatgccttagaaaaaataagtttaccaacaagagaaaaagataagccatttttaatgtcaatagaagatgtattttcaatacctggaagaggtacagtagtaacaggaagaatagagagaggagtaattagagtaggagataaaatagagatagtagggttacgagatatacagagcacagtatgtacaggtgttgaaatgtttcataaagcattagatgcaggagaagcaggggataatgcaggtatattgttaagaggaataaagaaagaggatgtagagagagggcaagtattgagtgcgcctggtcaaatacattcgtataagaaatttaaagcagaggtatatatattaaagaaagaagagggaggaaggcatacaccgtttttctcaaattatcagccacaattttatgttagaacaactgatgtaacaggtagtataaaattacctgagggggtagagatggtaatgcctggggataatataagtatcgaagtaagtttagataagcctgttgctattgataaaggattgagatttgcaattcgtgaaggtggtagaactgtaggctctggtattattactgaaattttggagtaggtattttatggtaacgcaaaaaatatatattgagcttaaagcattcgatagttgtttactggatagatctgcacgtagtatcattttaactgctaagaggagtggggcacgtgttaatggcccaattttttttcctcgtaagattatgaaatttattgttaaccgatctactcatgttgataaaaagtctagagaacagtttgaaattaggacacataaacgtttaattagcttgccaaaagctaattctacaattattcaggcattaatgagtttgcaattgcctgctggtgtagatgtaaaagttaaagtgattgggggcagcaatggctaagagaataggattatttctagaaaaagtaggccatacggcaatttttgataatgaaggtaaaaggattccaattactttattacatttacgagattcttttattatttctaaaaagactaaagatattcatggttacgatgcagtggtattaggggtagaagcttctattaatttaaagaagcctcaatcaaagattttagagaaaagcaaaattactgctaaatgtaagatttttgaatctagggttgataatttaggtgatgtagtagagggagctaaagtttctattactcattttgtcaaggatcaatatgttgatattactgggtattctttagggaaaggttttgctggtgttatgaagcgacataattttaaaggattaaaagcatctcatggtgtctctattgctcatagatctcaaggctcaacaggtcagtgtcaagatcctggtagagtatataaagggaagaaaatggctggtcaattagggaatagtaaagtcacagtacagaatcttaaggttattttagttgatcaggagagatctttattaggtgtaagaggtaataatattcctggggcgaaaggttcttatgtttttgtaaaagatgctgtaaaaaaatcagttccaaagggttcttttcctatatgtgctgaagatttaaagttagataatgttgtgtgagatcaatatggaagttaatataataaatgtaaatagtgataggattgggacgattgatttaaatcctctaatattttctgtgaattatagaccagatatattaaagatggtagttgattggcaattatctaagaggcgtgctgggacacataaagcaaaaactataggtgatatttctggtacaactgctaagcctcatagacagaaacatactggtagagcaagacaaggtagtttacgtagtccacaatttagaggtggtgctgttatttttggacctgtagtaagaagtcatgcttattcattgaataaaaaagttcgcaatctggggttaaaggttgctctatcattaaagaattcttgtaataaattattgattttagacagtattgatgttaattttgtgaagactacacaagtgttacaatttattaagaattttgagcataagtcgtttctgattattgataaggattataataaaagtgtagtttgctcttgtagaaatttgcataatgtaactttgttaaagcaaattggaacaaatgttttagatattttaagacatgattgcataattttaactgttggagctgtaaaatatttagaagaaaggttattatgattaattattttaacgttatacaatcctctattattacagagaaggcagtattgttgaatgagaaatttaataagtatgctgtatatgtctctgttgatgctgataagcaaagaatcaaaaaagctttaaaagtagtatttggtttggatgttattcgtattaatatcttgaatcagaaaggaaagaaaaagtatttcaaaggtgtatttggacgtaggaaaaataggaaaaaggtttatttttctttgccaaaagatcaaaattttaaatatatgggaatgaaatagaattaatatgggtattaaaaacttgaattcagtgacagcatctttgcgtggtactgtattattagataaatcaatgctatggaaaggtaagccagagaagtctctagttagttataaaatttctcgtggaggtaggaattctcgtggtgttattactgtacgccatcgtggtaggggtcataagcggttgtatagagttgttgattttaaaaggaataaggttggggtttctgcaactgttgaaagattagagtatgatccaaatagaacagcatttattgcattgctatcttatgatgatggtgaaaaatcttacataattgcacctaatgggttaaagaaaggtgatgtagttatatctggtgatggagctgatatattacctggaaattgtcttctattaaaatcaattcctgtaggcacatttgttcataatgttgagttaagacctggtaatggtggagtgattgcaagatctgctggtacttatgctcaattgatgagtaaagatggtatgtatgttttattgagattaagttcaggggaaataaggaaggtattatctgattgtcgtgctactataggtatagtatctaatttggataatcaaaatgtaaagttaggtaaagctggaaggagtaggtggttaggtattaggcccactgtgcgtggtgttgcgatgaaccctatagatcatcctcatggtgggggtgaaggtaaaacttctggtggtagaaatcctgttactccatggggtgtgccaacaaaaggtaagaagactagaaagagaaataagtctagtaataagtatattaagcgtgtatctgataaagggtagaatatgtctagatctataaaaaagcctcctttttgtgcgccacatgttttacggttagtaaataaggctatagctcaaaataaattaaattctattatcaatattcactctaggtcttctgtaatcttaaataaatttataggtttaacttttggggtttataatggtaagacttatgttcctgtaaaagttaatgataatatggtgggacgtaaatttggcgaattttctccaactcgtcgttacactggacatgtgggtgataagaaggtatctaggaagtaaattggttaggttatatgagtaaagtattgatagtagctaaaggtatggggttgaagtctactccttctaagttaaatttagttgctgatttaattagagggaaagatgtgtctgttgctatgatgtatttaaaattttgtaggaaaaagtctgctggatatatcagtaaagttttaaaatctgctgttgctaatgcgcaagctaattataatattgatcttgataatctttacgtaaaagaagttttagttggtaagtctttttctttacgtaggattcatgctcgtgcacgaggtaaagcatgtagggtgtataagcattatggtaatgttatcataaaattatttgagaggatataatttatgggtcagaagtctaatcctattggattaaggttaaagataatcaatacatgggattctttgtggtatgcaaataaggattatactacaaagttacatgaggattttttattgcgtaagtttataaagaaagctttctatcatgcttcaattagtaaggttgttatagctagaaaagtagatgtaattatggttaatgtatattctgctaagcctggtgtgatcataggtaagaaaggtgctgatattgataaagtaaaacagcagattgttaaaatgataaataataatattgaattgaatataatagaggtgaaaaaacctgaattaaaggcagttttaatagcagaaaatatagcacagcaattagaaaagaggatatcttttagacgtgcaatgaaaagaagtgtccaaagctgtttaaaaataggtgcaaaaggaataaaagttagctgtgctggtagattaggtggggctgaaattgctaggactgaatggtataaagaaggaagtgttccattgcatactttcagagctaatatagattatggtttttctgaagcaaaaacaatttatggaataataggtgttaaggtttgggtctaccttggtgatacgaagtcaagtaatgaataatgagtgagtagagattatgtttatacctaaaaaaactaagtataagaaggattttaaaggacgtattagtggtaatgcaaaaggtggatatactttatcttttgggtcccatgggttgaaagctttagagccaagtagattaacttctaaacaaattgaatctgcaaggagaagtatttcaaggactttaaaacgtgttggtaaagtatggattagggcattttgtcatacttctgttagtaagaaacccatggatgttcgtatgggaaaagggaaaggaagtgttgagatgtgggtatgtaaagtaaaacctggcaagatattgtttgagataggtggagtgccattaaatttagctagggaggcattgaataaagctcaagctaagcttccaatgaagtgtaaatttgttagtgatgaattgtaaaggtattgagctatggatattgttgatataaggtctaagagtaatgatgagttgcgcgaactattagtaaatttagggaaagaattagttaatgctgtattgaataggaaagttgataaatcaacaaaccacttttattgtagaaatataaaaaaagatatagccagagtattaacagtattaaatgagagaaggaaagaggaaaaacatgtctaataagaaagttttaacagggattgtagttgatgcaaaatgtgataaaactataaaggtaatggtttctcgtatgataatgcataaaacgtataagaagatagtaaagaaacgtaagaattatgtagtgcatgatgagcataatcaatataagtgtggtgatgttgtgaagatacaggagcatatacctatatctgctactaaaaggtggattgtaatttaaaaggtgatattttatgatacagaagaatactttattggatgttgcagataattctggtgcgcgtaaagtgttgtgtatagggttgttaaatggtaagaagtctgcttcagttggggatgttattgttgtttctactaagttaattactccgcgaggaaaggttagtaaagggaaggtttataaggcagtaattgttcgagtaaagaaagcagtacgtaggttagatggaagtgttataaagttttcaagtaacgctgttgtattaattaatgatcaaggtgatccattagggactcgtgtatttggtccaattaagaaattaccttttggtcttttttcaaaagttatgtctttggctgtagaggtgttataaaatgggtatgaagattattgctggtgatgatgttatagtaatcagtggcaaagataaagggaagatgggaaaagtaataaaagttttgaaaaaaaagcattgtggtaaagatgtttcttttgcaatagtttcaggagtaaatgtatgtagaaagagtgttaaggcaactcaaaaaagtgatggtggtattataagtgttgaaaagcctataaatctttcaaacattgcattatttgattctacgcttggaattcaaacaagagtagggtataaatttataggtgagaaaaaagtgcgttttatgaagtcttctggcaaagttatagaataggttgtttttttatgttaaaggatttatataaaagtcatattgtgccatctttaaagactaagcttggatacagcaatgtgatgcaggttcctaaaattgtaaaagtgtgtttaaatataggattaggtataaggggttctgatagtaaggttatgaattcttgtgttcgtgatcttgcattaatagctggtcagaagcctgtggcaacttatgcaaaaaaatctattgctggatttaaaatacgtaaaggatttcctattggatgtaaggttacattaagaaataataaaatgtatgagtttttagagaggcttattcatgttgttcttcctagggaacaagatttcaaaggattatctgtgagtcagtttgatggttgtggtaacttatcgattggtataaaggagcatatttcgtttttagaaatagattatgataaaatagataagatactaggggtagatattaatattgtcacgaatgcagttaacaataatgatgctaaattgttgttaatggaattcggttttccgtttattaattaagggtattcatgtcaagaaaatctgttatacaaaggaatctaaaacgtatatctatttgtaatagattaaagaataagagagaggaattaaaagctataattaaagatcaatctatttctatgaatgataggtttttagctcaggtaaaattatctaagcttcctagggattcatcttacattagaattaggaatagatgtttgattactggaaggcctagaggatgttatagaaagtttaaagtttctcgtattgtgttacgtcaattaggttcaattggacaaatacctggattgactaaatctagttggtaatattgaaaggaggggttagtagtgtctttgtcagatcctattgctaattttttaacaagtatacgtaatggacaattaagtatgaataaggtaatagtagtttcttattcttatgttattcatgctatactacaaattttactttcggaaggatatatagatgggtttactgaaaaatcaaaaggttctaatataaaattttttgaagtgaagcttaagtattataatggtgcacctgtaattagtcagatagctagaatatcaaagccaggtaaaaggtgttattgttcagctaaggatatgccgaaattttataatgggttaggtttgtatataatatctacatctaaaggaattatgtcggattataatgctcgtaaatctggtgttggtggagaaattttatgtggtgttttttaggagattaattaatgtcaagagttggctctatgcctatagcaattcctagtaatgttcaggcagacttggttggtaatcagcttatcttaaagaataatgagaattcattgaaattgactttagattatggtgtgctttgtgatattactgatggtaaaattgtgttgcatgttaatgataaatctatcaagtcaagagtaatgtggggaacttatagaagtataattaataattatgctataggtttgtctcaaggattagtagttgaacttgaagttaatggtgttggttataaggctgaagttaacggtgaatatttatctttatcattgggttttagtcatggggtaaagtataaaattcctacaggcattgttattcagtgtgttaaacctactcaaatattagttaagggttttgataagcaaaaagtatatatggtagcatctgatatatgttcaattagaaaatataatccatataaaggtaaaggtatttctattaaaggtagatatgttcataggaaagaagttaataagaagaagtaaagtggggtaatagttaaggttatggtgtataattgtggtactagacttgaaagacgtaaaaaacgtgttagattaaagttaaagagaaattcatctttactaaggttatctatttttaaatcaaataggcatttttatgttcaattaatagatgataagtgtgggagaacatttgcttcagcatctactttagaacgtgaagttgttgctttaacgaataggagggttaatagtgattctgtaaaaattgttgcaaaattaatgtctgatcgattgaataagttagataattgtaagaaatttattttcgatagaggtctctataagtatacagggatagtttctgagtttgcaaatgaattacggagttatggttttgagttttaataagtaggttttataatatggatgttgtaaagaaatcacgaaatgttcatggttctaatgatttttctgagttgatagtttctgttaggagagttgcgaaagttgtaaaaggtggccgtaggttttctttctcagttctagtagtgataggtgatgaaaaaggtaaagttggttgtggaataggaaagcatcttgaagtatctgaagctaaaattaaagctgttaatgctgctagaaaaaatatgatcagggtacatttacgtgaatctagaactttacatcatgatgtaaaagctaagttttgttcaagtaaagttatgttaagatcagctaaggtaggtacaggtattatagctggtggttctatacgtttaatttttgaagttttaggagtgcaagatgttgtagcaaagtctataggctcctcaaatccgcataatgttgtatatgctgtttttgctgcttttaggaaaatgctatcgccaaagcaggtagctaataaaaggagtagaaagataggtgatattattgaaaataggtaatttatggatacagttgtaaaattgaataatatatttagcgggttacctaaaaataagaagtctaaagtattaggtagaggtataggttgcggaaaaggtaaaacttctggtcgtggacacaagggacaaaaggcaaggtcaggggtttctataaatggttttgaaggtgggcaacagtctatatttactagattacctaagaggggatttaattccttgcttaagcataggtattcaatagtcaatttatcgacgattcaaaggttgattgatagtaaaaagattgaagatgtttctgctattacaaaagaggttctatataatttaggagttatttcttctattaaagaaaaaattaagattcttggaaatggtaaattaaatactgcggtagcaatagaatatgattttatttcaaaatcagcagaatcacaggttactttgttaagtaatgtatcagcaagtaaagaatagaatagtatttaagttcatagttaagtaatattatgtcacaaaaaatggatttactatcttggaataaggataatttattgggtaaactttggtttactttattttgtcttattatataccgtttgggtacatatatacctattcctggtattaatccagatgtaatagatgcagtagttacaaaacattctgtaggtgttttaggaatttttaatgtattttctggtggtgctttaggtagaatgactgtttttgcattaaatgttatgccatatatagtatcttctataattattcagttattatcagtaactattccaaaattaaatgagctgaggcaaaatggtgaattagggcggattaaaattaatagttatatacggtatatgactatttttttctgtatggttcaaggttttgttattttgcttggattagaaaagatgaatactgaaactagtattgtagttattgagcctggtctgttatttcgtatagtgggtattagcagtcttttaggtgggacaatgtttttactatggttaggagaaagaattaataaaaatggcataggtaatggcgtatctatgattatatttacgggtatagtagctgaattacctggttctttttcttctatgtttttattagggaaaaatggaaatgttccaatatttgtaattttattgatgttattggtattttttgcgttattgttattaattatttttattgaaaaatcttatagaaaaatactggtgcagtatccaaaaagacaagttaagaataagttatatggtagtagttctacttatattccattaaagattaatatttctggagtaattccacctatttttgctaatgctttattattatctccgattacagttgcaaattttcatcaaggatctccatggtctgattttatattaatgcatttttcatctggtaaattactatatatggggtgttatgcattattaataatatttttcgcgtttttttatacgacttttgtttttgattcaaaagagacgtcagagatattaaaaaaaaatggaggttttgttcctgggaagaggcctgggaatggtacttgtgagtattttaattatgtaataaagagattaactgttttagggtcaatttatttaacggttatttgtataattcctgagttaataaggtataattattccatttcttttactttagggggtactagttttttgataataatcaacgtaataattgatacgttttctcaggtgcagacacatttgtattcaagcagatatagtacattaattaaaaagtctgagttatggaaaataaaataaatatgttaatttttggtcctcctgggtctggtaaaggtacgcaatgtcatattttgtcaaaaatttatagtactatttctgtaatttcaacaggtgatttgttaaggagtgaagcaaaacttgatactgatgatggtagaaaaattaggcaggttattgaatctggtgatttagtaagtgatgatatagtgtgtaagatgtttgctaagtctattagtagagtaaagagtggatttttattggatggatttccaagaaatttaagtcaagcagaatttttaacggaaattctagaggaatataatagccgtattgatatagtgatacagttgcaattagatttagagacgataaagaataggttatatggacgtattgtgtgtaaaaattgtggacaagtttctaatttaaatttttttgatagagcaatagatgaaattgtttgtaagttttgtaaaagtagtcagttagattatcgttatgatgataaagtagaagttatcataaaaagggttaatcagtatgatagagagattaaaaaattagaaaattattatcgtgataagattgtgtgcattgatgcaggtaagccaatagaagaggttacttgtgatataaaagacaaaatagcccatttaattattggttgacgttagtttgcatatttgctatattacaaagcatttattatcttgtggaggaaagttagtggcgcgtatagctggagtaaatattcctacaaataagcgtatagttattgctttaacttatatatatggtattgggctttctttagctaatagaatctgtgaaggttgtaatattgatcataatgttcgcgttgtgaatttaagtgatgatgaaattattagaattaggaattttattagagagaattatatagtagaaggtgatctgaggaaagaagttagcatgaatatcaagtttttaactgatatagggtgctatagggggttaaggcataggagagggctacctgttcgtggtcaaagaactcatactaatgctaagactcgtaaaggtagatcgaaattgccagttgctgctaaaaagaaataacaaggtatattatgagtgtagtttataaaaagaaaaagagaaatgttgtagttggggtagtttatattcatgctacctataataatatcattgtaacagttacagaccagcaaggacattcgttaatatgtacttctgctggagcatgtggttttaaaggatctaagaaagctactccttatgcagcacaagagactgcaagtcatgctgttaaaacagttgttgaacaaaatgggatgaagacagtatctattaaagtttctggtcctggtgcaggtagggaatcagctataagagctgtgcaagcttgcaatttaaatgttacttctattaaagatactacaaagcttccacataatgggtgtaaacttccaggaagacgtagagtttaagtatatttgttactatgtgaggttctattgtgattttcgatgaggattctaattctattgcacaagattcgggttatatggcagtaggaaatgcatattctaatggagtgagttatatatcaatgagtgatcattggagtaaattaactaagccttcttctattaaggtagttcctagtggtgcttctccaaataaggcagatttaattattgaacctcttgagagtggttttgctttaactctaggtaatgctttaagaagagttatgatgtcttctttgcgtggttttgctgtttatggtgttgaaatagagaatgttttacacgaatttacttcgatttctggggttagagaagatgtaacagatattcttttaaatattagcatgatgagagtaaagctttctggtatgaatagtaaagttttgtctcttaaagttaaaggaccatgtgaagtaagatctggaatgatacctgacactgatgattgcattatactcaataaggatttgttaatttgcactttagatcaaggtgtagattttaatataaaaatgtatgtaaatgctggtaaaggttatgttcctgctgtaaagcgtaagtcagttaataaacttggtgatataccaataaatttcattgcaactaatgctctttatagccctataaaaaaggcgtcttttaaagtagaaagtagtcgtattggtcaatttacagattatgatcgattgattatgtctgtggaaacagatgggtctattttacctgatgaagcagtagcattagctgcaagaattttacaagatcaatttcaaccatttattaattttgatgaaactgatgagcctcataagaaagttgatgctaaagatacattgccttatgattctaatctgttacgtaaagttgatgagttagaactttcagtaaggtcttataattgtttgaaaaatgataatattacttatataggagatttagtccaaaagactgaatctgatatgttaagaactccaaattttggtagaaagtcgcttaatgagattaatgagcttttagcaagtatgaatttgcatttaggaatgaaaattgcgaattggcctcctgaatccattgagagtttaagtaaacaatatagtgaagaatgaggttatattatgaggcatcgtgttgctcatagaaagttttctcgtaccagtgctcatagaatgtctatgcttttaaatttgtgtatatctttaattaagcatgaaaggatatctactactttgcctaaggcaaaggaaatacgtccttatgtagaaaaacttattactattggtaaagtatataaggaaaagaacttagtttatgggaaaagattactaatttctaagattaaaaatcctgatatagctgataagctgattggtatattatcagtgcgctataaaagtagaaatggtgggtatactagaattataaaaaatggatttcgtaaaggtgatagtgcacctatggcaattatagaacttgttgataggcagataataactgttgagagtaacaagaattcctagttttattttaagtattattatgttttttatctcaagtgacttattatgagatttacactttcgtggttaatgcagtatcttgatacagatgtttctttagatataatagttaataagcttagtgatattggtatagaagtagataacgtagattattgtgaacacttaaaaacttttgtagttgctgaggtattggaagtagttcctcatcatgcagctaataggttaaaggtttgtcaagtatttgatggaaaggaaacttttcaagttgtgtgtggtgcttctaatgtaagagctgggataaagtctgtactagcacgtgttggcagtataataccaaaaaatcaatctgtgattgaagtagtaaaactgcgaggtgttgaaagttatggtatgctatgttctaaggatgaattaggaatagtagatcatagtaattctaatgatgggataattgaactgtcatccgcttataatgtaggaaatactttcttttcttgtgatccaattatagaagttagtattactccaaatcgtggggattgtttaggagtatatgggatagctcgtgatttagctgctgctggtatggggaagttgaaatgcatagataataatattgttaatgattctactgcttctaattcttctccagttgatatttgtatgcaagctgaaggaatagttaaggggagatatattaagggaataaaaaattgtgaaagtcctaaatggttaaaggataatctgttagtatgtgggataaattcagtttcgtttgttgttgatataacaaactatataatgctgtcttttaatagaccacttcatgtatatgatgcaagtaagataaagaagaagttaatttttaagaaggcagatagtcaaatggaattttctgctcttaatgataagaagtatattttagggacagaaaacattatagctgttgactcaaatgataatattcatagtgttgctgggataataggttctcagttaagtagttgctcattggaaacagaagatattttcttagaatctgcatggtttaaccctatggatattgttttatcttcaagaaaaattaaattgtctactgatgctagttatcgttttgaaaggtttgttgaccctaagtttttacagactgggctagatttagctacaaaaatgatattggagtattgtggaggggaattttttgatgttgtttctgatgaaaattatctaattaatgatataaggttagattttttgccagaatctgtaagaaaagtgggaaatgttgatattgcaacaaaacaaatttttgattttttagttaagcttggtttttttgtagataatagtaatgaagatgtgtggaaagttactgttccttcatggaggtctgatattcagcattcttctgatattgttgaagaagtacttagattatatgggtatgataaaatatgtgaagaacctatacctatttctcatgttgatgtagttgataactcttatgataggttgaggtcagtactgttgagtgaaggtttgatggaagttattacttggtcatttacaagtatgacatttgctaaaaagttaggatatgattcagaattgttgctacttgataaccctattaatgacaagttgaatttaatgcgtcctagtgttttattaaatttactacaggttgtttctgacaaccaagcatatggaagtagtgaagtagctatttttgaaataggtcaaatttacaatattgataatgtatgtagtggcaatagttatgtagtaggtggtgttaggtatgggaataatttcccgcgtaatctttataaacttgatagatctgttgatatttttgatgtcaaatctgatgttatcagcatattacgggaattgaatattaattccgatgctgtagaatttaaaaaatctgataaaccatatcttcaccctgtaaaatctgcagatgtgtattttaacaatattttgctagggtattttggggagttacatcctgatattatacatttgtacgaaatcaaacgtccagtagtttgctttgaagtatttttatataaaattcctcaaatcaatgtgataagtaaagagtttgttgaatcatgttatcagttagtaaaacgtgattttgcctttctaattgataaaaatataagtgtacagtgtttagtagatgttactaaaaatagcaatagtactttaatcgataatgttgtagtgtttgatttatatgaaggagataatataggtgataataaattatctgttgcattgtcagttacttttaggcctgttgaccacacattaaatgatcaagagataaaagatgcatctgatcgcataattagtgctgttgcccaggagctaggtggagttcttagatctttttaagtgtgtagtgtgctattcgttttatatatattttttagatgttatttaatcactacagtacataagtcagtatgtagtttttataattgtgcattttacttttaaagtgaacaagatgaaaattttgtttttctatgggctgatgttgtttaccttgtaattagttgtaatccgtgattatctaatcagatgtgttttaaaagagtaaagtggatattttattaattttcgtttatttacaatagcagatttacttttagtatctaatatataagcattttctaatgcagactaattttataagataggaaaataaaattctcaatttattgtgggttatagtcttttaagggaatatgtagtcaagattaggttgtttataaaataatatgtattaacatatgttaatattttaattattattaaattatatgctattggttagtataattatccgcaaaataacattattgttatgcaagaatcttaacgataatagagatgttcttataatttgggtaccaatattacagggaattggcataataatatacttttctttgactaatgaaccgcaggatgatgtattagtatacattgctttcttattattggtcggtttggtttttatttgtttaaggaagtatagtattttatttatatcagttttttttatcttattaggatttgttagtgtgcaaataaaagcacattattttgtaggtagtgtattacgacatcaggtgtatgtaagagatgttattgctacagttaaagaaataagtattcaacagtcaaacaaaagattagttgtgtgtgacatcaaaggtagcaaatatggaataaagtgtattaggttaggagttcgtaccaaattagacgataatattacaataggtgacatggtacaattttctgcaattatttatcctccatcagttgctgtatctccattttcttatgacttttctcgtatagcgtattttaaaaatatcagtgcagtaggttttgcagttagtaatatatgcttattcaaaaaaagcagaagtagacgagttacagaatatatagaacttataagattgaatatatataaggtgcttctgcgtagcctaacggaagatagtgctaatatattaagtgcactactaatagggaaaaaagaaggtattaaaagtgatatcatggatactattagaaatacaggaatagctcatctttttgctatttctggattgcatttatcttttattgctgggttatttttttctttatcaagaagtttattagtattgtttacaaaatttgctgaaagctatgacataaagaaaatctcttctgttatagctattgtggtgagcctaatttatttgttaattgctgggatgcctgtttcaggtcaacgtgcttttattatggtaagttgtgtttttattggtatattgattgatcgaaatcataataatttttgttctatagcggttgcatcatttattatattattgtttaatcctgaatcattgctaagcccaagttttcagatgtcctttgctgctgtacttgctcttgttgctagtcataatatttttttaagattagtagttatgaataatatagtacagtatttttcatcaattgttttgagttcgctgattgcaagtttggctacacttccttatgtagtatatcattttaactatttttctatagcaggagtttttgctaatttgcttgcaattccaattacaacattttttataatgccattgggattgttatatattgtattgggtattgtcaatttggaattttgtgtttcgtggatgctagaaagcacagtaaatttacttatatatatagttaagtatattgctaaaatagatggattagtagtattgtttcatgctttttcttcagtatctatattaattattactttaggatttttatttttgtgtttatggaaaggaaatatgagattttgtggattaatattagttatactgggattttttgttggtattagttatgtaactcctgatattatgtttaatcaacacaatattgtagttaaagagttaaatggtaaattatatgcaattaatcaaaaggctcatttgacaagttttataaatttaacatgggcaagacaaaatggtcagaagaaaatgttaaaacattattctggaaataatcaatacttatcctgtgagagagcagggtgtatatataacaaattgggaaggaatgttttgattgcttataatgctgattatgtaatgcaaaattgtcaggatgtagacttaattatacaggctaagaagtttatgtatccgagtgaatgtttaacacagcatattaattataataatactagtaagtcatatgttatttggataacaaataatgagataaagattgatgggatgtttggtaacagaatatggaatacataaggagtaatgaattaggagtagtaaattttagtgatagaatagttgccgtttacttgtaatgtatggaatatacttattcatgatttatgcattgttggtatacgagtaatgaaatgtgtcggtaatcaagttgttagtaattctactcttttcatatctctctacagttaagattgcaaattgatgggggataggaaaggataaaaaatcatggaattccgcatgattgtactgtaatttattgtgtataaaatgaattcaattttaaatgaattttagttgttatatatactaatcagaatatttattcttgatacttgttagtgatattatgttattgttaaaaaactagtttacctcgttaatagtacatccattttaatataatgaactctgctctctcagtataaaagtgtactgaaatacaagttgttcataagaagaacaaaattgataaggtatctggtggaatacgtggatttttattattaagcataatttgtttctaaacacctaataaaatgcactcttctctctcgactaagaagtgttacttgaatataagttgttacaaagcagcacaagattaataaggtatctagtgaaatatgtagatttattattaggtacactacatttttattattgagcataatttgtttctaaacacctgataaaatgaactcttctctgtcaatataaatgttacttaaatataagttgtggcaaaaaagaacaaaattgatgaagtatctggtgaaatacgtagatttattattaggtacactacatttttattattgagcataatttgtttctaaacacctggatcaaatgagctcttctctgtcaacataaaatgttacttaaatataagttgtgacataagaagaacaaaattgataaggtattttagtaaaatacgtggatttttattattaggtacattacatttttgttattaagcatgatttgtttctaaataaatcacctaataaatgaacatgtattgacaacgttcttctatattagttagttttttgttactgctacactttaaatatgtttttgtattttggtagtaatattagtatagcaatagtgttactaattaatattagtgatatggaaatgtcagctatgtcccatagaagctgcacttttcctaatgctcctattggtattattatagtgtataaaattttccacattttgataagtaaactatcttttccatctgtaagacaatataaagtgcttttagcacaaacaaaccatgtgaaaacagttgtgaatgagaagcaaaacatgattagtatgataacatagtttatgtattctgaatcgaatgcagatttaaatgcagcaatacacatgtttgtactttcaagagggccagaccatgcattagttaccagtataactagggttgtaactaatgtgacaatcactactataaatggtgaaattaaagaaatcatactttgatgtgtattgaagtttttactattactattgatagaggaatgaaccataccctctaaccctaatcctatatctgttgcaaatatacctctaaaagtgcctacttgaattatatgaaatgtttctagtatgaatgcccctatcattcctgatttaaagctatcaaaagttaggaaattagcaaacattaactttatagaaggtataatattgtcattaaatttataaagtacaaaagatgctagtattatatatgctatagccattcctggtacaagtcttgaaattaatgctgtaataatttccaaccttaatattgtaacggcaaagaacattgcacacatgaataatcctgctattattggtggtttgttaattaattccattggtattgatagagagttaacttgaacaaaattacctattgcaatagaacatatgagcatgagtatggtgaaaactatgacagctttttttgacttaaatgcatttttaaaatatatagcgggccctccaatatattgtttattgactttaacccgtgtctctatacttagataacaagttacatatttaataattgaacagagagttactatgattatcatccataaagcaaatcctgggcctcctgattttaatgcaactgctgtgcctgaaatattaccaacacctaaattcccccctattattgtgcataatgcaccaatagaaaaagacttgtcacgatacttcttcattgtgattaatgaaatcgcacttggaagttttgtaatttgtaagaatttagattttattgataagtaaataccagtaaacagcaacagaaaaactgctggaaaagataatactaaatttaatatactcatagtaattcacacacgttatacaagaaaaaacttataggaatagccagttacctaaaacttcaagacttcttaagaatataaacttggagtatttaaataactttttaatctcaatgacatttctttaaaatttacctttggtgtatacctattaccaattaatatataataatatcccttaatagcatatttaacaagaacactttgtgctaacacgcgaaaacgtcttttaactttattacgcacaacagccttaccaactttcttactgactgtaaacccaactctaacacacccatcctctaaaagaccattaggctctttggcgacctgtaaaaacaacccatttccacctacaaaggtaccattattccttgcaaataaaaaacatttccttttttttactgtgactacaccctttaagcgcatagaacacgacgaccttgagcacgcctgcgatttaaaatccttctccccatcttagttgacattcttgatctaaagccatgtctacgcttgcgtacaattctactaggctgaaaagtccccttcataccagaatttcctaataaatgtcaaaaccatgtctataagctacatggtgttgtaatatttgtcaagaaggatatttgattaatggaaataataatttgtaaatttagttcttggttgaaattgttttcaaatattaaaattacagctgtgaattcatggtgaattataaaagataaagaaagtagtcatctaatgtaatggtactataattttttttatttttgttaaagtggtagtgtgcgtatagttacgcatgttgctacttctatgtctggtcatattaggaggatgtatgttgtgtaaaataaaggatattatatctaatttcaggaaatatcatttgctattgaggttacatagtgtagaaataattttattattgatatttcctagtttagctagtatagccctagtatctcatagtgtattacgtgcttgtggttatatgtttttatgttccataggagcatttattatgagaccagctgggtgtataattaatgatatttttgatagaaaaatagattcagaggtaaaaaggacacaaaataggccattggcaaataatagtttaagtgtttttcaagcattgaaaatattagcaatacttttattgtgtgcgtgtgtattacttgtgttgactaatatgtatactattaaaattgctattgtatcaatggtattgattgttttatatccgttagctaagagatattttgcttggccacagttattgcttggaatagtctttaatactggaatattgatgggatgtactatgactgttggtcatttaacattaagttgtgtactactttatataggatgtattttttggacggtaggttatgatactatatatgctgcgcaagataaggagtatgatataaaattaggattgcaatctactgcaataaaatttggtaatgatattcgattatggattggacggctatatatgattactgttacaatgtggctttctgctggaataattgctgtgttgcatcctattttttatctagcaattctgattattgctgcaattttttattatcagtataaaaaatcagattttgacaacccagaaaaatgtatgtatatgtttaaagtaaatatatatgtagggttgattttatttttaggcactgtgtttggtagaatattataagcaatgtgaaatagtgctgtagttgtgtggtgggtaatttaaataaatgcagattggtgattggtctaaaactcatataaaatcttgtttcagtgagtttgttactggtataacagttgttactacagtgagtcaaaatggtagtatgcatggaattactgtgaattcatttaattctgtttctttagtgccgcctatggtattgttttcaattgagaaatctgcttctaggtttgaaatatttcatacatgttcaaagtttattgtgaacatattgagtgataaacagaaaagtatatctcaaaattttgcagagtgtgatgtgcaaaattgggaagattttagttatagtgttctggatggtattccaatcattaatgggatcatgtcttatatatactgtgctaagaaatatgtatatgatggtggagatcataagattatagttggtgaggtcataaattgtgcaaaactaaataatgatgataaaccattggcgtactacaaaggtaaatatatggttataggaggtgtgttatgacacgagtaaatataggtatagttggttgtttgggtaaacaagggagaaggttggttagtgaaatatcagcgagtccttatgctcaagtaagtggggggcttgttcgttcaggaaatccacatgttgggcaaattttaggagaagttgtaggatgtgattgttctgtcaaaattactgattctttggaacatctttttgaaacttcagatattgttatagaatttactaatcctgacatgttattagagtgtatcaaaatggctgaacagaagaaaaagcctttattaagtggtactactggtccagctgctacagaaatggtttttgaagattatattaagagtataccatttttatggactacaaatgtaagttttggtgttaatatacttgcaaaattggttcaagaggctgcaaagaagctgtttgattatgatattgaaatatgggagatgcatcatagatataagaaggattctccatctggtacatctttaattttaggaaaagctgcagctaagggaagaaatgttcctttccaaatggctcaatatgtgagaggtactccacaggaagctagaaaagatgtgaatactattggatattctgtatctagaggtggtgctgatttaagtgatcatagagtcatgtttgtcagtgatgaggaaatgatagactttaatcatagaacgttaaataaaaacctttatgcaaaaggagctttaaaagctgcattatggttagtcaagcaacctcctggtgtatacacaatgtcagatatgatggctgctgtagagtagttatttaattagggttaatatgtcacaacgaattcatgcttcagctagaaatttaagtttatggtatgatactaaccaaattttatatgatataaatttggatgtatataaaagagaagttacagcttttataggtccttcaggatgtggtaaatctactttcttgagatgttttaatcgtatgaatgattttatatcaaattgtaaaattaagggtagtttaaatgttgatgacataggtgtttattctgttaatacgaatgtggttcttcttcgtgcaaaagttggtatggtttttcaaaaacctaatccttttcccaagtctatatatgataatgttgcttatggtccaaaactacacgggttggctaagaataagaaaaagttagatgaaattgtagaaaaaagcttaacaagtgttggtttgtgggaagagttatgtgatagattaaaagataatgcttttgaattatctggtggacaacagcagcgcttatgtatagcgcgtgctattgcagtgaggccaactatgttacttatggatgaaccatgttctgctcttgatcctgttgctacaaatgtaattgagaatttaatacaaaacttaaagaaaaattttaccattattgtagtaactcattctatgaagcaagctaagaaaatatctgatagagtagcagtttttgattctggaagaatagttgaatataatactactcaagagatttttcaaaatccacagtcaagtaaaactcagaggtatatagtagatcagttatagtaatattttatataaccacatggtaagtttgggatttattgtatctatgaagatgtaaatggaatagcattttttactgtaatggctaatgaaagtaaggcttagaaggcttggataagatacaaaaataatagataaattatatgttaatatgaagctggattattgcatatattaggatattaaatcattcgaaaaattttttcaagacccatagtgagtaaaatgtaggaagtaatttgatagtgttaattaaggagaatttttttaattctcttaagactgagtttttattttataacccattggttttgttcttctgctagtgtattattaagtattgcttttctaatagactccattaagttattcataaaatatatattgtgtatactaattaaactgtaagctaataattcttgtgcttttaaaagatggtgtatatatcctcttgaatgattacaacatgtaaaacataagcaatctggttctatagggtttgtatctattttaaatctttcatttcgtagatttatatgttctttagtacgggtttcttcttttctgtggtttggttttactaatgccccaccgtgcctagctattcttgttgggtatacgcaatcgaaagtatcgatacctgcttttacgccttgaaagatatcatcaatattgcctattcctaataggtgaatagggcgatttttatctaggttgcttgttgttaatgaaacgatgtcatacatttgttgtttacatgctcctaatgaaccgccaattgcatgtccaaagaatggcatatcatttataaagctacagctattaatcctaagatcttcatgaattccaccttgaattatcccatataatgcttgagaataattgttattttttttaaattgatcaatgcatctgacagcccatctatgactcatattcattgaattttttgtgtaatcataactaacatggaatggagtacattcatctagtacaacaattaaatctgctcctagtttttgttgtatttgtatagatttttctggagttaggtgatatgtgctaccgtttatataggatttaaatatagctccttcctcgttaatggaaactagggtttttgaagtgtactttcttcctgcgcttttaatttcatgtgacactgaaccataccctaaactaaatatttggtatccacctgaatctgtaagcattggtttattccaaccagtaattttatgcaagcctcctaatttttcaataatgtcttcaccaggttgtaacattaggtgataagtattagataatatgatttgtgtatttgattctttaatttttgatatatcaacagattttatagctgcttttgtagcacagaatataaaggctggagtattgattataccgtgaggagtaagtatggtacctagtcgtgcgttattgtgttgatgtataattttgaagttaaaatttttgtacataagtaagtaagagattcagtagttaatgataatatttaaattattttctaaatttttgctaggtgttagttgaaaaatatttgctaatttgcgtgttttcaataataatgtaggctagtatttttaattttggagttatattaatggctgtaccaaaaagaaagaagtcaaagtcacgtcgtaatatgcaccgttcacactgtagattgaaagttcctaatattggtattgataagacaacaggggagtataaattatctcatcatgtatgcttaggtggatattataatgagaaacaggtattagaagtagatagtagtaatgtatagttaatttaattttttgggaagtatgtaaatgagcataatatcaattgcagtggatgctatgggtggagattttgctcctgaagcagtagtaagcgggttggattttgctttaacaaatttattagatgaccaaaatgtttcttttaatatatacgggcagggaagccaagtgttgcctatattagataaatataaggatttaaaagaacatagtgtatttattgatactccagaagtagtattagcaaatgataaaccatcctttgcgctaagaaaacgtcgatcttctagtatgtggtgtgcaattgatagtataaaaagtggtgtaacctctggagttgtatcttctggtaacacaggtgctttaatggctatttcacgttttttgttgggaacacttcctaacatagatcgtccagcgatttgtactgctcttccttctagaggtgaggagtattttgtattattagatttgggtgcaaatattgaaagcagttcaaatgctttatttcaatttgctattatggggagtgcttttgcaaaagctgtgttgaatattgctagccctaaagtagcattactaaatgttggccaagaagaagttaaaggcacagatgttatcagagaagcatttttattattgaaacaagctgaaggtaggataaatttttgtgggtatattgaacctattgatatactaggagataaagttgatgttgtagttactgatggattttgtgggaatattgtattaaaggtagctgagtctattgcatatacttttaagtcagtttttgaaaagtccgttactagttctataatatcaaaatttgcaggattattgctaaaatcccagatgaaaaaagattttatgaggtttaatcctaaaatgtataatggggctatgttattaggtctaaatggtgttgtggtgaaaagtcatggaaatgctgataaggtagcttttgctcatgctattaaagtgactgtaaatgctgtgcgtaatgatatcaatgctaaaattattcatgaattaagttaatgttattctatgaaaagatctactatactgggaataggctcatatttgcctaaaaaaatagtaacaaatgatgaacttgctttaactgttgaaactagtgatgagtggatagtaaaaaggactggtataaagcaaaggcatattgctgagaataatgaaatgacatcagatatggcagcaaatgcagcaaggttagctttgactgatgcttgtgttcataaggatgacattgggttaatcattgttgctactactactccagatagaacttttcctagttgtgctactatagtgcaagataaattagaatgtaaaaatgcatttgctttcgatattcaagcagtatgttctgggtttgtatatgcaatatctattgctgataattttattaaatctggtcaggtaaatacagctttagttataggggctgaaattatgtctagaattttagattggcaagacagatcaacgtgtgttttatttggtgatggagcaggtgcagtagttttaggtaacaattctgaaaaggatagtggtattatatcaactattttacattctgatggagctttttgtgatttattgtataccactggtggtactgcatataatggtcatgctgggacaatctgtatgaatggtactattgtatttgaacatgcaattgaaaaattgagcgcttctatacttgaaattttagaccaaaatgatttagaaataaatgatgttgattggtttgttttacatcaggctaatatccgtattattgaattggtagcacgtagactgaaaataccttatgaaaaaatggttgttagtgttaattggcacggtaatacttctgcagcatcaattcctttagcgctatcttatgcaaagagttctggaaagttaaagaaacacgatattgctatattggcagcaataggtggtggttttacttggggaacatgtttagtacgtatttagctgttagattgtattaaaaacagtgatgtatttttgattagtggaaattaagttatctataaattactcttttcttagttttttaaaaaaatctgttataagttttgtattttctgcttctaatattccaccatatacttctgggacatgatggcaaaattgaaaaattctagctccattttcaattgctccatattttttgttgtaagctccaaaatataatctacgtatcttagaaaatgatattgcttgtgcacacattgcacatggttctaaggttacatatatatcacattggtttaatatatgagtagataatattttacatgcatttcgtatagctaaaatttctgcatgagcagttggatctatatcatgtatgtttgagttattagcagaagatattacttcattgttatgtactataactgctcctacaggtacttctagcagatcttcttgtgcttttgatatagctaatttcatgtatgtatagttaaacactgttttattttttagttaaaggagtattatataatagaaaggagttgattagtatttatatattttgataaagggggtggttaccattgtggtaaaattgtgatataatatacacgtagagtttttatatatttttatgtattttgatattcttatttatttagtcctagctttaggtattttaggcatttgtattgctttatttaccttctataaaagttatatacgtgagagtatttttaaaatatttgttgataatgattatgatgaagatcaactaacagatgaagagaaatataaaaggtatatagagaaaaaacaaaaagagcttataaaacatcagatgttaataaatgatgttgctagagatcaagtagagtataaaagtaatattaaaattattaatgttatggagccaataggccagtggactaagcttgtgatgtcagagaaattacaaaggtttgctggattgaagtttgataaagagcaaacaggcttttggcaaatgtttgttagtatgagatccttatctcaaggaaagtataggggaagatctaaatagttaatcagtactttctctttataaaatctaaaagtaacgataaatctacatatcgataatagttgttataatacatatgttgtgtgatattataagtctgataaataaggttgtttaattattatattgagaaagtttgtacactatcatacttgtaagtgttgatatataagtagcatttatatgttatcaaatgtaagatttcatttttttaaatatatgagtaatgaagcatagtaatttttagtatgtttatcaagcaataaattatagagaaattttattcatgaagttgtgctataaataaaactctaattattacaagaatttaatgtattcttattgttgctaaataagtgtgttagagaagaaattgtaatgtgaagttggaaatatattaattgggtttttttaagttgttagtgactgtaagatgttataaatagttataatcgagtttttatctaaattgtagtaatgttattttgagagggtattttggaattaaaatcaaacactagtaagaattttggccaattaatgtctgagcttccctgtaatattgaagctgagcaaatactattgggttcaatgttgcgtgataatagaatttgtgatgcggttgaagatataataacaagtgatgtgttttttgatagtcttcataggcgtatttttgaacaaatagtaaaaattaataagcgtggattggtcgctaatgaagttagcttaaaaatgttttttgataatgatgaagatttaattgaatctggtggagttgactatttagcaaaaattgcagcaaaagctagtattatttttgatattaagaatgttgcaaatatagttgttgatacttatttgaggagatgcctgatttcatttgggcaagatttaattagtggtgcatataattatgatgttgataattctgcagtttatcaaatagaaagtgctgcgcaaaagttattcttacttggcaatcaaggaaaatctgataaaacttatcatcaatttgcacttttagttgcaaatattaagaaaagaatagaatttgcaaaaaataatgaagggacattgcaaggtgtgtctgtagggtttcgtgatttagatcagctgctaaatggattacagaagtctgatttacttattttagctgcacgtccatctatgggtaagacagctttagcactaaatatggcattaaatgcatgtaaaattttaagtaatagtagtcagtacaatgggcaacatattggttttttttcattagaaatgtcagcggagcagttggcttctagggtaatagcaattgaatcagatgtaagttcttataaagcattatctggaaaaattagtggggaagaacttaaaaaagtacttgatgctagtacgaaggtatgtaatttgccgttaattattgatgattcatctagtatttctataagtagcttaagaactagaattcgtaggatgcatcagctgtataatttggaagctgtttttatagattacttgcaattagtcaagggtacgactaaacgcagtggggaaaatagagttcaggaggtatcagaagttacacaagggttaaaagctattgcaaaagaattaaatataccggttgtagccttatctcaattatcaaggttagttgagcagcgtgatgataaaaagcctcagttatcggatttaagggattctggtagtatagaacaggatgctgatgttgtaatgtttttatatagagaagaatactatgaacttagaaaacagccatctgaaggtacagctaaacatgttgaatggcaagaaaggatgaattcaataagtaatgttgcagatatattgatttcaaaacagcgtaatggtccaattggaaatattaaattattttttgaagcagaaaaaggtagatttagggattacacagcaaaatataatcctgcagattttaatttttaaaattcgtttttttatactgtggctttctagatagagatcactgtataaaatgagtaggtttatttttgcaaatagtagtagtagtgatcttacgtacaagatatacgttgaaattttgctataataaatagaaatatatgtgtgagatatttttaaaggaatttctacagtatgaaacagtttaatacattattggtcttgtatactaaaatgtgtagaaattttcctaataacaaaaactatgtaattcattctcaatgaaaatatttgatcaaatgttcacctatacactggatatgtaatgtagtaagtgtctaacttactataaatgatgattatttgtatatggtgaaatattcaaaattgtatgattgtaattttttatagtgaaaggtaggagagagttcaattagtgtatttaatatgtggtgtgttttacttttaaataagtgatttgtgagtgtagtttaatgtttagatattagtttttataataaagtacttttttgtgtaggatttcatggtaattttttataatgaaaggtaggagagagttcaattagtatatttaagatatagtgtagttttacttttaaataagtgatttgtaagtgtagtttaatgtttagatattagtttttataataaagtactttttatataggatttcatggtaattttttatcatgaaaaatacaagagagtttgtattagtatattaagatgtagtgtggttttacttttgaaaaagtgatttgtaggtggagtttggtgtttaaatattagttttaatgtaatgaagtactttttatgtaggatttcatgtttttattaagatgcttttaaggtatgaaatgagaaattatgttactataaagattattgtttggaaattttatactagatttgatcatgaataaaaaagcaggggttgtaggcgcaggattagtaggtagattattagcgttaaggctattacatgatggttggcaagttactttgtttgataaatttggtaaaaatgatagacgaagttgtggtgctattgctgcaggtatgcttgctttatattcagaatcagaaaaaatggagcaaatagtttttgatttaggtataaagtcattaaatttgtggccaaaaattctcaatagtatgttgggtaatacttcttttaagatgcttggcagtatagtagtagctcacagaaatgacatgtcagaccttgaaagaatgatgatgcttataaaaagaaaatcacatgttagtaatttagagataatagatgagaatgctttaaaaatatttgaacctgatctctcttttccttatggattatatataccaggagaggcacaaattgatagctctcagctcttttataatataatgcgtactttagaacaatataatgttacttggtatgaacatgttgttgttgataaaattatagatgaaattgtggttatagaaagtggtaaagaatataggtttgattttgtttttgattgtcgaggtataggagcaaaaagtgatttgcctaatataagaggggtgagaggtgaagtattgttattacatgctccacaagttaatttaaacagaccaattagaatggtgcatcccaggtatagtatatatatagttcctagacagaattttcaatttgttattggagctactgaaatagaaagttgtgatatgtctgaagtttcagtacaatctgtactagagttactatctgctgcttattcagtgcataagggttttgctgaagcaagaattatagatatgtcagtgaattgtagagcagccttttctgataatttacctaaaatatatgttcataataatcttattaggattaatggtctgtataggcatgggtatttattagctccgtcgttgatagaagaagtagtattgttgcttaatggaaacttgaatactcattcctcaattattgaaatggttagctaatatagagtaataatgattttgttttaggtagtcatattctgataatttacctagaatatatgttcataataatcttattaggattaatatctgtattggcataggtatttttattagctccatcgttgtagaagaaatagtattgttgcttaatggaaatttgaatactcattcctcaattattgaaatggttagctagtatagagtaataatgattttgttttaggtagtcatattctgatagtttacctaaaatatatgttcataataatcttatcaggattaatggtctgtattggcataggtatttttattagctccgtcgttgtagaagaaatagtgttgttgcttaatggaaatttgaatactcattcttcaattattgaaatggttagctagtatagagtaataatgattttgttttatagatgatcatatacttatggtttatgattcttagttaaatgtggattatggtgttaataattttttagagtgtcattagatagtgtgttaattattttaatgttatttctgtgcttttcaaaaaggtaagcaaaaagctatattatatctgatctttatgttaataatccacaattttatataagaagagtttgatttttaatagtcactttatgtgatgtatagttctaatagtttttggaaatattattcaataatgttcatatcaattattttaatactattttcatcaaaattttcaggtttttcgaaattagtaaaaagtttaggagatacaatcatggatcgtgtcatatctgatctcatattaatgagtcctaactctatcgcaagaggagcttcatttttgccaatttctacttttaattcttgatcttctagtaatacttttccatttgattctcgtactgtatattttacgcttacactatctccacagtgtatcttattgacagtaccttcataattttcaatagtattgttaaaaattaatatatcattgacttcatctggatatgatgaattaatggatattaatttaacatagtattgttcttttaagttgccttcttggtctgttagtataataatacgttcaccttcttcttccatacctgctattgtataatttagttcttttataatactttctcctaatttaaatgttacttcctgtggaatattttttaatgcttgagaaaggatgtttttgctttctgaatcatataggaatttatgtattattgcggaaatattttgtccacatagtgcttttttaccatttccttctacaatatcgtgtattttaaagagatctggttttatagttttatgtttaatgtgctcaaggtaatcaactaatccatttatttttatgtagtaatcaatacgagattcaatgattggtcttaataaatcatatcctataatgtgtgtcagagaatgattaacattaattttgtatggtttattagaaagatttgtatgttggttgagtgttgtttttgtgtataatattgttaatgcttttcctacaagtgttatagctactatggtaagacagacatataataatctataaaatattttcttcatgtttttttataaatttcttataaactcagctaaactgtgtaggatatctgctttatgtgaaagaatagttaaatgttcgatagatttgtctatcaagctattaagatagttttgagcatcttcgttatttaatatattgaggatgttgttttttgatttatcctgatttgcgtcagcaatgtcatcttttacttgaaaagcatgtccaaggtttaatccgtagttagctagagcatttaattcaatatttgatgcattccctaatattcctcctaattcacatgctacagagaaaaattgggctgttttcaacacgtggatggcttgtatatcatttgtgtcttttgctatagtttctgtatcaagtatttgtccttgtatcatgccttgataacctaaagctttagctaatgcttttatcatacagcaacgtataaatggtgattcatcaattgttgataatatttcaaatgctagagttaatagtgcgtcaccagttaatattgcaattgcttcgttaaattttttgtgggaacttgcttgtcctcgacgtatgttttcgttatctatacctggtaaatcatcatgtattaatgaataaacatgtataatttctacagctgcactgacaggtagaattctatctacattaacgttgaatatttgggcagaagcattaacgagaaaaggacgtatatgcttgccaggtgcaaacatagaatacctcatggatgttaataatatatcttgattattttctggtagaatactttctagttgtttgacgagtaagctactatgatgtttcattaaatctgatatattgcagtacaaatttccctctatatgttgtttcctttgtatcaaagattataaaagtctgagaataatatgcaatgtaatttatagtggttgttataaaagatttatattatcttttatttaattttttagctattttgtcatttcttttaatagatattttatataatgaacatattttagtatgtatatttacataataagtaaattgctgagaataatgtttgactatgctgatattcacttttataatcagctggcatgactccttcgtctagtggtctaggaccccaccctttcacggtggtaacgcgggttcgactcccgtgggagtcacttttgttctttcttttgtatttttcgtagttttaaataaaaacttgctttcctattgggggcatttgttatattaatcacaattattagatgattttgcagtacaattttttttaatagatgttttgcatttctatatattgtgctttatatagtaaatatatacaatatgtatgcgtgagcaataattcctattatgcatagggtttgaataataagaaaggtagagattatggggacagtaattgttgattatgaaagagataataatcttacagcttttggcaaagctgtattgtctgataggtatttacttgaaaatgaagattatcaacaactgtttgtaagaatttctgaatattattcagacaatccagaacatgcacaaaggttgtatgattatatgagtcaactatggtttatgcctgctactcctatactaagtaatggtggtacaaatagagggttgccagtttcatgttttctcaatgaaacagaagatagtttaagaggtattgttaatttatggaatgaaaatgtatggttggcatctaagggtggtggaataggaagttattggggaaatttgcgttctataggtgaaaaagtacgtggtagtggtaaaacttctggtattataccgtttattgtagtccaaaatgctttaactttggcaattagtcaaggatcattacgtcggggtagttctgctgtatatttgcctgtttggcatccagagattgaagaattcttagatttaagaaaaccaacaggtggtgaccctaatagaaaagcattaaatatacatcatggggttgtattatcaaataaattcatgaaatgtgtagaaaatgatgaaccatgggatttgatcagccctaaagatcagtcggtactttttactataaaagcacgtgatatatggataaaaattttgacaacaagagttgaaacaggtgagccatatatattatttattgaccaagttgataacaataaacctgaaatttataaaagactgaatttagacataaaaatgtctaatttatgtacagaaataactctcactactggatatgatcatttaaataagtcacgtactgctatatgttgtcttgcatcattgaatcttgaatattatgaacaatggaaggacaattcgttgtttattgaagatgttatgaggtttcttgataatgtgctaactgattttatagaaaaagctcctagtgaaatggaaagagcaaaatattctgcgatgcgtgaacgtagtataggagttggagtgatggggttccattcatttttgcaaagtaaaatgataccctttgaatctgtagcagctacaatatggaataaaaagatattttctcatataagaaaacatgcagatgctgcgtcttataatattgctatggaaaaaggttcttgtcttgatgcacaagatgctggtattgtagagaggtttgtaaataagttatctattgctcctactgcatcaatttctattattgctggaaatacttctcctggtattgaaccatatgcagcaaatgtttttacacataaaactttaactggttcttttattgtaagaaataagtttttgcaaaaattgttaaagctaaaaggtaaagataatgaacaggtatggtcttctatatcaactaatgagggatctgtacagcatttggattttttaactgaagaagaaaaattaatatttaaaactgcatatgaacttgatcaaaggtggataattgagcatacaagcgatagatcaaaatatatatgccaggcacaatctgtaaatatttttcttcctgctaatgttcacaaaaggtatttgcataaaatacattttcttgcttggaggaaaggattgaaaagtttgtattactgtagatcaaaatcaatccaacgtgcagataaagtatctcatggggcattagaaaaatcaattgaacaatataagcaaattacaaactttgattataatgagtgtttatcttgtcagtagtagatcttattattaagtaattactgttcttcattatttgcagttagtatactgctgctatatcatactgagcgtttattttactagtgcatgttataaatgaaaagttagtgtttcatatttatgatgattagcttaaaaaattaagtgtattattatagttcatttttatggatgtatgaaagtttaagaaatttctatctttttattaaagcatatcaataatattgggtcataattagtttgttatatgttcaggtaatgtttagcaatatgtgtactgacgcgtaatattttagaatgaatggaagtggtatgttatataaaagtattgatgaatttataaaggttatatagataagacaaaaagatgatcagcttaaaaaattaagtgcgttattatagttcatttttatggatgtatgaaagtttaagaaatttctatctttttactaaagtatatcaatgatatcgggtcataattggtttattatatgttgcggtaatgtttagcaatatatgtactgacgcgtaatattttagaatgaatggaagtggtatgttatataaaagtattgatgaatttataaaggttatatagataagacaaaaagatgatcagcttaaaaaattaagtgcgttattatagttcatttttatggatgtatgaaagtttaagaaatttctatctttttactaaagcatatcaataatattgggtcataattagtttgttatatgttcaggtaatgtttagcaatatatgtactgacgcgtaatattttagaatgaatggaagtggtatgttgtataaaagtattgatgaatttataaaggttatatagataagacaaaaagatgatcagcttaaaaaattaagtgcgttattatagttcatttttatggatgtatgaaagtttaagaaatttctatctttttactaaagtatatcaataatatcgggtcataattggtttgttatatgttgcggtaatgtttagcaatatatgtactgacgcataatattctagaatgaatggaagtggtatgttgtataaaaatgttgatgaatttataaaggttatagataagacaaaaagaataatgggtttagattttggagagaaaaagatagggatagcgttaagtgatagaacaaatttaatagcaataccttacagtgtgtatgttagaagaagcagtagaaaagatttaggtagcttatatagtatttttgtagagaatgatgtagggtcgatagttataggttggccgcttgaattgagtggtgtagaaaacgaattgtgtcagaaggtagtgatgtttgcaaatcggattataacaagatataaaattaatatttgtttacatgatgagaggtatagcactgctatggctacaaggctagcaaaattagctaatattaaaagaaaagaatctcaagcaattgatgataaaatttcagctgtattaattttacaacaagtgcttgatataataaaagtttatcaaatgtagaaaagtagtatcaatattttacaggtggatattgtaaatgtggtgaccactctattagagatgatgctgtatacctatatataggatataaggtaataagagtattataatgatcaatagtaatgaatatacttaaatttctgctttataatctgttttataacatgataaattttctgttataagaatggatatattagattttaatcacttatttccacatcaataatttaagtgacagtattattttagtaagagtgactattataattctttttaatttgcagaatgtacatttgtaataattcacattttttactacgtgttttaggtattaattgaatatgattttaatattttcttgtttttaaagtattttatgaagtgaaattgtatagtagggctcttatatggacaatttaaggtaatatagcatgactttttcttgtgttcttatgatctacggtcaaataaaacttaagtatctttaagtatatatgctattgtagaaaatcattgttgagtataatcatagaatttctttctgggcctgtagaaatcaaatgaatagggacttttaggatttcttctattttctttatgtacaatatagcgttttgtggtaaatccttatacgatacactgccaaatgtgcttgtttgccatccaggaagtatttcatatattggttctaaattactttgtatgtgaggtgaagcagggaggtaatcgtatgttttatctccgtatttatattttacacatatctttatttcactgaattgatctagtacatcgagcttagtcataactaatcctgatactccagatagcattattgcttgtcgtgctagtactgcatcaaaccatccacatcttcttttcctattactgacagttcctaattcttttcctgttttaaacatgatttttcctatatcattgttttgttcagtaaaaaatggaccattacctactcttgttgtataggcttttactaatcccagtatgtaagacttattagatggattgataccacatccgacccatgcttgtgatgctatggtattacttgatgtaacaaaaggatatgttccatggtcaatatctaggaatgttccttgtgctccctcaaaaattattgtcttattttgttgtgttaaattatatatggttttccatactggttgtacgaatggtaaaatttttggggcaatattcaacagttcattaactatatcctctgcctttataggtggggtattaagactttttcttaatagattatggtagattagaagatgattaactttgctgtatagcagatcttttgtatctagtaaatcacatactctgatagctcttctgctgattttatctgcataacatgggccaattcctttgtttgtggttcctatagtatcttgtctaagttgttcaaacagtatatctgcttgtttgtgtacactaagcactagtggacaagattctgatattgcaagattttgagtagtaatgttaataccactgcttttcaagttatcaatttctgaaacaagtgcataagggtccaaaactactccatttcctattatggacagtttattgttttgtaaaacagaagatggaagaaggtttaacttatatactttatcatttatgactatagtatgtcctgcattattgcctccttgaaatctcacgacagcgtctgcattagtggatagccaatctacgacttttccttttccttcatcaccccattgtaaccctacaactactatatttaccatagcttttctgtataaatcccaagccacactaacaaaataaagaaattgtgtcaaatgatttagtagtcatagtgtcctatgtgtatagtatcaacccagaaacctggtattggatttcaatgttgagaaattatgtatgtaatattttaatcaatacatagcttatatgtataaggctttttgtatgggataaacaataatacattactttttacatactgaaaacatatgtagaaagtaatgcatattgttaaaaatttgtagattgaaatgacaactgtttatgaaaaatcatttcaattatctatcattgttctgttttattagaggacggatccttgtctgaagatttagctttatatataagattatcagtaagtgttatcacaactctacgatttttagtatgagcgtattcagcttcttctggattgttagagtacactaaaactgctggttcagactttcctttagattctataataattctatcctctaaagacttattacgctctagaatgaaatctttaacagcatttgcacgctgtttgcctaattctaaattatattcatctgttcctctagtgtcggtatgtccaacaataatgatattagtatcaggatactcttctgccttttgcataactttttcaagtattgttttatcagaatcctcgattgttgcctttccaaaaccgaagtatattttttcaatagtcttcgtattagaaaacacatgatcaacatttaccaatggaacatgatcagtagttttacagctacttaaaattaagcatagtagcatgaatttaataaataccaacttatgtttcatagtgcctcaattgttttaaacaagattatcatgatcattgcttaaaattatcttaagtcaagagaaaaatcaaattgtagctatattactggatttatacaataatttactctagttagaaattgataattttgatgttattaaaaagcaaatattatgagatatacaagtattttatatacaaattatgttgtaaaattcagtatctgagttattgcacgttcattgttttttttattttctagtaattcttttatttcaagaaaagtggttgattttaaaacgttaaaaaggatttaacatgaaatttgttatgataaatctgtaatttatcaatagtaaaaaacgtgcattcaagttattttgtgagagtgtttaaatgtttttataatgttgatgtagtgtatagcgtagtgcttaatgcaaaggttgtgtaatcaatgactgtatttattgtcttggtttaatagaatttatttaaattttttagacagagaaatattgatattttgtgttgtattgcgctaatataatcaattatcattatcaactatattattggaaattgtgtgatgattttctgtatcaatatttttgtattaatgttttacctggtgtagtgtatattggtatgcgttgtgtgattagtatattttagaaaagttctagcatgcttattgatattatttaaatgaatttttgattaactgactaagtgaatttaacctacggaatattatacatatgaaacattataaatttttggagcaagtttttggtaaaattggaaatattaattctattattaatgttttagaaactagtgaaggtaatttttgcgataaaatagagcacatttgtacccttaaagaaattaagcatgagattcttaatagtgagatgatcggcgatatgatacaacattctgtagctaataaagcacaattaaatgactgggaaattgctaacttgaaccatattgagctgatacataagaatagtagtgcagttcctgtggagttggtattagacctttatagagcgcaagttaagtgtaaaaattcttgggtattattccgtaatggtgatgcttctatacaagatatagttgctttattgtctgatgttgtaagattggtaagtgatattgcttctattaaagctgagagtttaaagatttctaaatatgatgttattttaggactacaagatagtaaattgaatacaagaaaagtagatgctatatttactgaaataggagcttttttccgtcagtttatcactgaggtgggtgataagcagaaacacaataagatttgttatccaaaaggtattaatgaagagaaacagatacttctaggttatgatgctttgtcgagttttggtatgacaaacagtaatattattaatagtgattatgtaaataatagatattcatttgggaaagatttaccttttttagttaattatagtgaagatgattacagaatcgggttaaaaactttattcagaaaaataggttatgctttgtatgctttgaatttacctgagaagtggcataaacaacctgtagggtggaacttaaataacattctatctgaaattttggggctgttaacatcgaatcacttaatgatgagtaaggagtttgtaaagtttatatctcctaatttaaagaagcgattttcttttagaggtaaggttgggcactatgagaatattcagttatattttaacgaagtgcaacctaatttgttgatgcataaatctgatgaggtgactctactagctcatattatgctgcggtatactttggaaaaggaaatgataagtgattctttgcaagtacaagacttgccagatgcttggattcaaggaatgaaacactattttaatgttgctccaaagaatgatttggaagggtttttacaagatgattattgggtgagtggtatttttggatattttccttgttgtatgatttctgctattattgcttctcagattttttctactatgaagaatactgatgttcaagtgttgtcacaagtagaaaagggggatttatcatcatttatcctgtggataaataagaatgtatgtgattacagtacgaagtacagtagcatggatttgttaaaaaaagttacaggtcagaaattgaatgttaatttctataaaaattatcttacaaataagtatctcaacatgtagatcgttgtatgtgtttagctaaagctatgtattgttaatttaatgagaatgaaatatggacaacgaatataatgatatggtaaatatggctaatgccattagggtgttatcagtagatgctatacagaaagctgcgtctggacatccaggtatgcctcttggaatggcagatgttgctacagtattgtttgcaaagtttttaaaatttaatcctaaagatcctaattggtttgatagagatagatttgtgttatcaaatggccatggatctatgttgctgtattccatattatattttttaggatgtttagatatagaagaaataaaaagatttagacaaattcattctttaactcctggacacccagaatatggatacactcctggagtagatgctactactggcccattaggtcagggtttagcgtgtgcagtaggtatggcaatagcagaaaaaatattgtctgaaaaatttggcagtgaaattgtaaatcatactacttatgttatggttggtgatggatgccttatggaaggcattagtcatgaagcagcatctttggcaggacatttgcagttgaataaattgatagtattatttgatgacaataatatttcaatagatggtccaatttctttatctgtttcagatgatgttaaagctaggtttttgtcttatcagtgggatgtttttgaaatagatgggcatgattttggtcagattgaatcttcaattaaaaatgctcagaaatctgaaaaaccttctttgatttgttgtaagacggttattggaaagcatctttcttcaaaagaaaatacatgtgctgcacatagttggccattttcagaagaagaagtaatgttgatgaaagagaaattaaattggcaatgtaatccatttaatataccagaagaaattttgcagttatggaagaatgtttctagtagatcagaagatgaatacaacatgtggcttgataggtctgcgaaatatagtaaaacttttgatgattttgtagatatgatgaaggaaggtgttcctgattcagtttttttaggtttgaaagaatttaaaaaagaactttatgctttaaacttaagtgaagcaactcgtaggacttctggtagagtattagaagttatagcaaagcatacaagtaaattaataggtggatctgctgatcttactaattctaataatactaaaccacagttaatatcaattattaacagaagtaattttaatggatcttatttgcattatggtattagagaacatgctatggcagggtgtatgaatggtatggcattgcatggtggaatgattccttatggtggaacatttttagttttttctgattattgtagaccagctattagattgtctgcattgatgaaaaaacaagttatttatgttatgacacatgattctattggagtaggagaggatgggccaactcatcaacctatagagcacttatcatctttacgatcgatccctaatttatatgtttttagaccagctgatgctattgaagtattagaatgttgggaaattgcattaaagttaactagttctccatctgtgtttatactatctagacaaaatgttggcagtgttcgcagtgtatctgttgatgagaatttatctaataaaggtgcatatgttatacgtgaatatgagaaggatttagatgttaccatttttgccacagggtctgaagtggagattgcactaaaagcatctgatattttgaaaagtaaagggttaggtacaagagtagtatctattccttgctgggagttgtttgttcagcaagataaaaagtatatattcaatttattgaataataaaagcattaaagctgcggtagaagctgcaagttcttttggatggcatagatacataggagaaaatggtatttttgtaggtttagaggattttgggatatctgctccatataaggatttatataaacattttggaatcactgcggaaggtttagtaaacaagatacttgataagttgaaaattaatacaaattagatgaatataagtaatcaattttattaaatatttgtaaacgaaatttttaagcattgtagaacaaactttaattggtttaatctattttttagtattgaattataatgtagaattcacagagctttagcaattatattgctatgtttaatttatccagttttgagtgtaaaaatctttaaaaattatgttgttataataaaaaatacattttcttaaaaaatatagatgtatgtttttaagtctctaagtattaatgtatgtgttttacgatttaatctaagttttagttactataatttaaatgtttgtgtattaataatatttgtatatattgattttatcattgttatcgttggatgaaatgttagtatttacagcttgtgtgttattattttgtatggggatgatgttggtatatttggttactagtaaaaccatatatgataaaatacttgctgcaaatttgtttggaacgtattctatagttttaattgttgttatcggaatcataaatgatacattttctttattgatagatgtgtctttagtatatgcgtgtattaattttatttctactattgggtttatgaggttttttcttcatggttcttttggagatataaaaaaatgatggaatatataagtatagtagtgctagcattgggaatatttctagttattacttctgtagtaggagtaatgagatttcctgatttttatacaaaattacatcctgcaggtataacagattctttaggagcacctttaattttaattggacttgctatgcgatctgggttttcaatttttacaattaaagttttgttattaatctgttttttatggattactggtactacggcatcttatgcattagcacgttctgcttattacaaagagaaaaaaggtaaagatgatgctgactgatgtgaattttattataaatgttattttatctttatttttagtattcgtgtcatcttgtttggtattatttaaaagtcttactgtgaatgtgataatgatgtgtatatttagctttttgatggcattgttgcatttagtaatggatgctccagatgttgcaattacagaagctgctgtaggggcagggataagtactatactaatgttggttgctttatcattaattgatacagatgagaaacaaacgtgtggtaatataaaaatatttcctattattgttgtattaggagtgtttgtaagtttgatgtatgtaatacctgatttacctgtttttggtgatgctaattcttttgcaaataatcacgttgcatcttactatgtaaaaaacacttactcttatatgggaattcctaatatagttactgcaattttagcaagttttcgaggatatgatacttttggtgaaacggttgtaatatttactgcttctttgggaatttctttattgcttgctaaggataatcatcatgtttaaagatccagtgttgcgaacagtatctattttaatgatacctgttataattttgtatggattgtatattcaatttcatggtgactatagtccaggtggtggttttcaggctggtgttattgttgcatctgcaattattttacatggtatattatttggattaaaggtcactttaaaagtgatatcaccctatattgtcagattaattggtggtattggtattttgatatatggaggtactggtattgcatctatgttacttggtggtgaatttctctcgtattctactttggctagtgatccagtattgggacaaaagttagggatatttcttgtagaactaggtgtgggcatgactgtgtgtagttctatgttgactattttttttaattttgtatcttcttataaagaataaatgtgttttctaatagttttatttattttaactctggtatatgattttgagttgttttaattacattgtgtctataatattgatggttataggtttgtatgttactactgctaataaaaatcttgtaaaaaaattaatagggttaaatatatttcaaacttctgtattgttattttatatttctattggttatgttagtgatggtaatgtaccaattttaaatgataaagtaatattgtatactaaccctttacctagtgttttgatgttgacagccattgttgttggggttgcaattttagctgttggtttgtcaataattgtaaaaataagaagagcattttcttcaataaacaataaggaaatacgtagataaacaaatagttaatgttttatttgtttatattttttgagtgtagataaaataaggtgtttttatttttgaaatcttgtctatactattataattaaaggctatagttaagtgagttttaggtgtaagtctagtgtcaaatcataataaaaggatattaattgatgcagtatatcaagatggaattagagtagcagtattacgtgatggacaggttgtagagtttgatcaagaatcaaagaataaaaagtgtttaaaaggaaatgtatattgtgctgtagtgaaacgtatagaaccatctttacaagcagtatttattgaatatggagcaaataaacacgggtttttgcctttttctgaaatatcattagattattataatatttctgaagaagagaaagaaaaattatatcaagtattatatgaagattctgatgtaaaaaatgatgatgatgtaaaatctgtagatgactctgttgcatgtgatactaaggatcaagataatgttagtgattgtaatgacaagttgacattattgaagaaagataatttgcgaaatggtaagtctaaattacctttttacaaattgtataaagtgcaagatgtaataaagcttgatcaaaaattaatggcgcaaattgtaaaagaggagcgtggaaataaaggagcaactttttcaacatttattaccctggttggtagatattgtatatttatgccaaattctggtaataagaatagtggaatatcgcgtcgtattgaagatgctgatgatagaaaaattttaaagaattttctaagtgctataaaactgccgaaagaatcaggaataattattagaactgctgggtctaataagaaccagaaagaaatagagcaggatttatcttatttacagtcgacttggcgaagtatacagaatagttatataagtgttactatgcctttattgttatatgttgaaggtgatataataaaaagaacattacgggattattgtgatgagaatacgcaagatattattgtatcaggtagctacgcatatgagttagcaaaagaatgtgttaagttcatgtttaggaacagggtgcgtcttagaatttataagggcagtgttcctattttctcttattacaaaattgagtcgcaaatttgtgaactatatggaaatgtagttaatttgccttctggaggatatatggttattactccaacagaagcgttggtatcaatagatattaattctggtaagatgacaggagaggatagtattgaggagacagcttataaaacaaatatggaagctgtaaaggaaatagctagacaagtaaacctgcgagggttatctggattaatagtgatagattttattgatatgttaaaatatcgctattgtaggtcagttgaatctgaaattaaagaagcttttaaatatgataaagcaaaagtacagtttggctatataagtacatttggtttgatggaaatatcaagacagagggtcaagcaaagtatattagaagcgaatacggtacaatgttcacattgtaaaggagtaggtagggttaggtctttggaatcttcttctggagatatattacgtgatattagatattgtgctaataagaatcgtaataaattgatcaacatttctgttgctggacaaatggtagagtatttttttaataataaacgtcaacatattgctgagattgaagaagaattcagtgtgtcagttaagttaactgtgaatcaaaatacgagtagtgtatctgattttaatattagtgttgaaaatgatgatatgttaaatcaaggtaaggatgctgttaatgtatttactgttgattataaaatttctgaagataataaattaaaagaggaaatacaaaaaactcctactggaaacatgtggataaagaagtggttgacccgcatattttcacatatttaattcataaatttatgaacttgtgttaaatggggttgtaatcttatgatttggttattatatctgtgattatagttttgatttttatgtaagggggctatttatggctgttataggtatagatttaggtacgacaaattcttgtgttgcagttatggagggaggtgatgcaaaagctattgaaaatagtgaaggggctagaactacaccttcaatagttgcatttactgattcagaaaggttagttggggatccagcaaaacgtcaagctactacaaacgctaagaatactatatatgctagtaaaaggcttataggacgtagatatcaagatgtgaaagatataaaatcatcttatgatgtggtgtctgctaaaaacggtgatgcttggataaaagtacttggcaaagaatattctccaagtcagattggtgcatttgttttggaaaaaatgaaagaaacagcagaaagacatcttggacataaagttgagaaggctgtgattacagtacctgcatattttaatgatgcgcaacgtcaagcaacaaaggatgcaggaaggatagcaggattagatgttattagaataattaatgaacctacagctgctgctttggcgtatgggttaaataaaagtgataaacaaaaagtaatagcagtctatgatttaggtggtggtacttttgatgtttcaatattagaaattgctgacggtgtttttgaagtaaaagcaacaaatggtgatacaatgcttggtggtgaagattttgaccacgctattatgaactatttgatggatgattttaaaaagactacaggcatagatttacataatgattctatggcagtacagagaattaaggaagcatcagaaaaggcaaagatagaattgtctaaccgtatggaaactgatataaatctgccatttatttctagtgatagtactgggcctaagcatttaagtttaaaattgactagagcaaagtttgaaaatttagttgatgatctaattcaaagaactattgaaccatgtaagaaggctcttaaggatgctggaatatctgcagataaaatagatgaggttgtattagttggtgggatgactagggttcctaaagtaatacaaaaggtaaaagaattttttggtagagaacctcataagggtgttaatccagatgaagttgtagctataggtgctgctatacagggaagtattcttgctggtgatgttagagatgtattattattagatgtaactccactatctttaggtatagaaactttaggtggtgtatttactccattgattgaaaggaatactacaattcctacaaagaaatctcaagtattctcaacagcagaagatggtcaaactgcagttactattaaggtgtaccaaggtgagaggaaaatggcagctgataataaattattaggtcagtttagcttggaaggtataccttcagctcctcgtggtatgcctcaaattgaagttacctttgacatagatgctaatggtatagtacatgtttcagcaaaagataaagcttcaggtaaagagcaagctattaagattcagtcttctggaggattaagtgatgatgaaattcaacgaatgataaaagaagctgagcaaaaagctggagaggatgagaagcgtaagaaatttattgaactgaaaaataatggtgaaaatttagtgcactctacggaaaaatctttaaacgaatatggagataagattccaaattctgataggcttgaaattgagaatgctattagagatgtaaaagatggtctcagtagtagtgatatggaaagtgtagatgttttacagcaaaaagttgatcatttgatgaaagtatcaatgaagctaggtgaagctttatatggtaatgctgctaataatccttcatctgctgagaacagtacagcaagtaataacgaagaagaagattctaaagttgttgattctgattatcaagagattgataagaaggatagcaaatagtactactactcttattgagttatgtgacaatagagttgataggtccactatattgtgttaggattgcattgggagtttctgtattgtacgttgaagttaagttaattcctcgagctcgattgatttttttagggagctgtcactgttagttatggagactaataaatggtgcccaccttagcttaagtctcaggatattcagagcatagacggcaatggcggtttctccccatatggggtatagttttgtgtttcttacagaatcttgttatgtctaacaatgaatataacttaaatgatagtgaaattatcaatttttctgctattgatttattcaatatagtattagatgttgaaaagtatcctgattttcttccatggtgtaaagcagtttacgtaaaagagcgtagaggaaatgtaatagtagctgatttgttagctagttttaaaggattaagtggtcaatatacttcaaatgttatgtttaaagagcctactgtggatcaagaagggtggataaaggtagaagcagtagaaggattatttaagtttttacataatcagtggacttttattccaaaaggagaaagtcaaacgttagtacagttttacataagttgtgcttttaaaatacctatgttacagtccgcatttaatttggtttgcgatactgcatataagaggataatgtcttcttttaaaaatagagcaaatagcttattattaccaaaataatgtatctatttaatgttgatactatgttttacaagttacataggatagttaatatattcaacaaataaatggtgaatctgtaattttatttttacagattatatttaataatcctgtgtattagttgtgctgaaactgaaagataatttgttattattcaaaaagatataattgatcatgtatcagcaaaaaatagataagtagtggaaagtacatgttttataataacttaatactttattgaaaataaatcattacatgtagtagatttaatgactaaaatttcttcattggaagaaaagaatctttgatagttctaattaacataatgagcgtgtaatctttttatgtaatagtttttattgttgttgatatatatgttcagtatgaatatcaataattcaagaatacttgtctattttttctgatgttgtttcaattatttattaattgtagtatgatatcgtgcaatagtacttgttattatttttgtacagaagaataaattattttggtatgatgtacattttaatttctaatatttagtagctatttttaatgcgatttagtattagttatatatgcttgaaaaaataataatataacttgagttattatgactgagtatcttgctaaccgcttctctattatatcttttatacctaaattagcttttttagtatttgttgtattagagctcctgttatacgatacaaggactgaaacatataattatagtctaatattattttttgtattttcttttattattgttctaatttttttatatatttggaatataaagaagcatgagacgattttatatcttttatattatttaagtagtatagcagctatttcttcaggaaatttattgtctttagttatatcatttgaatttatggcattgagtgctctaatgatagttgctgtaaactcttttggagctaataaaaattcagtgatacattattcatgtattcattttttgtctggtgtactgttacttattggggcatctggtgggtttttagggataattaatggtgagtattattataaattattttttttaataggtttattgatcaattgtgcttgctttcctttatcttcttgggtgacagatgcttattctgcagcattgaataatggtattttgatcttatctgtgtttactactaaagtttcagcatatgtattattgttcttttttcaaggagaaaaaatattactgtttttaggtatagcgacgtctgtttatggcataattttttcaatgttggaaaataatattaaacgtttactttgctataatttagttggacaaatggggttggttatcactgcgatagggttttcttataatgatggtgttgatatttatggtataatcgttttacagatagtcctgtctataatttatcaaactttattatttatggttgctatttctgtgataaatagtactcaaaaatttaatcttagtgaaattggtgggttattcaataaaatgccagtagaggcagtatgttctgcaattgctatatttactatgggagctttacctggtactggtggttttgtttctaagtttctaattacacataatataaacaatgtagatcttgcaagtgtgttgatgggtaaattgttcttgatatgtagtatattgttatttgtgagtgttggaataaaatttttttggtatgcatttatatctaaagctatagaaagtcctattgttagaaaggtttgtgcagcatctaagttatcgatgttgatattaacattagtttgtacgttttttggagtatttggaagttactatttgtttcatgatctagatagtgaaaagctaagtagtattgtgttgcagtgtggattaatatttggaagtatattattctttatctgttttcatccagtttttaaagggagagttaattttactatggacattgattgggtctatagggtattgtttatgagtgtaatactgtttatcaataattttttgttatgcatttataatattcttattacaatgttaaacaatgtattaagtacaagaatattattgtattttaaagatggtaggaaaattttaggtatatcaagtattgatcctttaggatttactataatatttggtatgttatttattattattatggtcgttgtatatttatgtttgagtctttaactagtagtttaactaatgtaatccaaaagatgcagagtaagcatgttatttcttctgaggattttgatgctgcgatggaagaagtaaaagttgctttgcttgaagcagatgtttctttagctgtagttaaggattttattagtaatgtaaaagagaaaatagttggtggcactactgtaaaaggtgtattgccaacgcagatgataataaaaaagatccaggattgtttaattgaagtattaggatctgaaaagtgtgaattagatatttctaagcctttgtctgtgattatgatggtagggcttcaaggtgttggtaaaactacaactacagctaagttagcgttaaaacttaaaaataaaaaaaaggaagtagtaatggcatcgttggatgtgtatcgtcctgcagctcaaaagcaattggaaatattaggcaaacaaatagatgttcaaactttaccaattattgaaaatcaggctcctattgatatagtaaagagagcaatggataatgctcagcaggctaattgtgatgttttaattttagatacagcaggaaggttgcatgttgatcaagtgatgatggaagagttaagggctataaaagatcttacttctcctagtgaggtaattttagttgttgattctatgataggtcaagatgctataaatgtagctaagtcatttaatgataatatagggattacaggtattattttaacccgtattgatggtgattctagaggtggtgctgcactttctatgaaaatgtcagttggtagtcctattaaattcattgctaatggagaaaaattaagtgatctagatgatttttatccagaaagaattgccaaaagaatattaaatatgggtgatgttgtatctctagtagaaaaagctacagaagctgtaggcaagcatgctatagatgagatgcaaaaaaaagctcagaaaggtaaatttgatttaaatgatttagtacaacaactgaaggcgttaaataagctgggtggtattgccaatattttaaaatttatgcctaattttggtgctgatgttaaacgtcaagtttctggaattgcaaatgatagtagagtgaaacagtatattgcaattgttaattctatgacaaaaaaagaaagagaaaatcctaaaatattgaatggtgcacgtaaggctagaattgctaaaggttctggagtacatgttaatgttattaatatgcttataaaacaatttaatcaaatgagtagcttgatgaataaatttagtaaagttgactatagtaagattaaaaatacagacttcatgaatatgtttaacaaagaatagtttttatcaggtggtatatatttatagagaagtattatcgatatgtgtttgtaaattctaagtttttatatgaaagctaaagtgcaataaagttctgtagaatagggaatttatagcatattacttttattaatgatttagagtatccttagtaaaatagttatatattgtatataataatatgagttgtatagtttgtgaattttttatatcagggatctatgtgataaagagtctgttgtaagattgtataatggattttagcgaaaattactttctttagtagtctataaatatttatataattttattgtaatgattgaagttagccttttaaattgttaaaaaattttattgcatactatatgtttttggtgtgtaatgtaaaagttggttttataatgttcacttacggaattggtgttgtattagccaaagttttacacagtagcattaagagtttcaagtatatactgtataatttttatgttttttgtaaatgtaggaatgtactgtatatttaattacttagtattagcaagggaatatggatcatataagtaaaaaatgttctatgaatgctatagttggtacaactaatgcaggaaagtcaacattaattaatatgctagtaggacaaaaggttgcagcagtgacgccaaaggtgcaaactactagagttaggatgcatgctgtattgaataatgagaatgttcaattgatatttatagatacaccaggtatcttttctccgaagacaaaattagaaaagtttattgtaaagcatgcttggatgtctcttaaaggtattgaaaatgtaatactgttgcttgatgtaaaaaattatttgaataagcatattgagaagattattagtagaatcaagcaatctaatatcaatgctatcttagtagtgaataagattgatacagttcctacatcttcagttgataaagcaatagaacatatgtattcactacatagttttagtaaaacttttactatatcagcattgcatgatattgggttaagtcgtttagttgattatctatgtgaaatttcacctaatggtccttggttatatcctgaagatcagattagtgatgcaccattaaaattttttatggctgaaattacacgggaaaagttatttttgtctttacaccatgaattaccttattctttatctgtagtgactgaagcattagaagaaaaagaagatggaagtttagttgttaagcaggtaatatatgtaactaaagatagtcataggactatcattttaggcaaaaaaggagagatgataaagaaaattagcatggaatctagatctgatcttgcaaagatccttgatttaaagatacatcttttcttatttgtaaaagttagagaattttggcaaaaccatttagatgaatgtgtagggtatgttgaatagtttattggtttttgatatagaaacaattccagatgtggatgtttgccgtaatctcctcagtgattttgatgagacagttgagttgagtgagaaaagggaagcattaataaattaccatttagatattactgatggtaaaaatccatttttaaggcaaccttttcataaggtggttgcaattagttttcttaaagcagatattaaaaagatgggagaatatgaatctttccatttgcaagaaatacgttctggtggaaaaatagattctgtcgaaaaagatttgcttaagggattttttcaatatgtttcatctttgaggccaagatttgtgtcttttaatggacgtacttttgattttccagtgttaaaatatagagctatggtacatggtatacaagcagggtgtttgtataaaattggggataagtggaataattattttcaacgctatagcatcgactggcattgtgacttattagattatctttctgattttggtacttctgctagaataaagatgaatgaagtgtgttcagtgttaaattttcctggtaaatttggtcttgatgggtcaaaggttactgcactatatgatagtggtaaaatatctgaaattcgagattactgtgagacagatgtaataaatacctatttggtgtatttgagaatgatgcattatcaggataggattacaacactaagctataatgatagtataaatgacttattgtcgtatttagattccagtggaagagaacatttcaaacaatttagaattgagtgggataaatcttgtggtggaaatttttatctttaatcatatataatatattcaattaattaatttatatatttgctagtatatcattattgtattagtaagttttttggaatccattatgcggaatgtaaaatatgtattattttggttaggttttatagtattagtcatgctatttagtggtacaaaggatgatattggtggcaataaatactttaataaattttttcctaatgctgcaactcaaaataacaaagttaattatgttgaaggaggagttgaattttatagagccaaggatggccatttttatatagaagctatgatacatgggattccagttaattttttagttgatactggagctactgatgtagtcttatcagtggaagatgcaaagagattaaaacatcatctgaaatatctaaataagaagaaaacttatcatactgctaatggtacagtaaaggctttgtatgtggaaatatctgagatgcaggttggaaaatttgttgttaataatgtaaaggctagtgtaaatgtttctccgatgcgtacatctcttttaggaatgagctttttgcaatattttcattttaatatgagtggagataagttaacattacattcttattaatctgtagtacttatataatcgaatgataaatttttacgaaaatacttattataagtattaagcaactgattgcttatggcatgtgatttttaggttaagctgtactttatttacagatttaaataaatgtttctagtagtgaattttgtaaggaatgatacaacaagtaatttgtcagtgtctaacttggattggtgactatcttgagtttatcttaatatttttctaataggtaagttttgtgtatagaagattctcgaatgttagcaaatatttacatggttatgatacatgatgtttagttgattattaatgtgttttattttttcagatagggggaaattattgatcataatactacatgagtattgattctaaatgtatctgttcagtatgtggaattagataaaagaatagctaacatgtgtaactgtatctattgtgttgttgatttttggataatgtttaaaaatataagattgttagtagtaagtttgtagttgataaaaaaggctgctgtgccttgtattatgtagtaatatgtatctttattatttatcaagtgtgaaatttatgaaaaataggttaaatcaattaattggtttaatggaagagtatgaaattgatgtattgttattgcagaatacggatgaatatcagtgtgagtatgtgcatattaacaagcaaagaataagatggttgtgtggtttttctggctcaaatgctactttgataatatcaagggaaggtaaacagaatttttttactgatggtagatatacattacaagcaacaagggagttggactgtagttattatcaaatacataatgtgtgtgagttaactccttggcaatggtgtgtagaaaattgtctatctcatactgttgtagcttatgaatctgcattgtttactttgagtcaaataagaaagtatgaagattgtggtatttttttaaaaccaatagatcaaattttgattgataagttgtggattcgtgattttgctatagaacatgatatagtacagcattctttagaatattctggtgttgagagttatacaaagtcttgtgaagttgcaaaatatttgtctgacaaagatgctgcattaatcacaaatactgatgttatttcatggatgttaaatatacgtaataaaaagtttctttataatccttcagtgttgtctagagcgattttatataaggatggaagagttgatttatttattgatgatgtttactcagtaaatgttaaatatgagcatcttaatatatgttctttgaataatctatttaatgttttgaaatctgtaaaatcagtagttgtagatgcatctactataccaatgagtatttttctatctttacaacaacaggatgtattagttaatgatgcagatttttgtcttttaatgaaagccagaaagaatgatgttgaaatacaaggtgcaattaatgctcatgttagagatggaatttctatagttaatttattatactggttaaatatgcaattggataataatcagaaaattacagagctggatgttgagtcaaaattattagatttcagaaaacagcaaagtttgtttcaaggtgaaagtttttctacaatttctggttttcaagaaaacggagctgtaatacattacagagcgaataatgatacaaataagttaatatgtaagaatggattatatttattagattctggtggtcaatatcttgatggtacaacagatgttacgcgtactgttgctataggtgaacctacatctgagcaaattactaattttacgttagttttaaaaggtcatattgctttagcgatggcagtctttcctttaggtactactggtggaatgttagatatattagctagacagtatttgtggaaatcaggacttgattatcaacatggtacgggtcatggggtgggaagttttttatcagttcatgaaggtccttgtgctatttcgtacaagaatgatgttgtattgcagccaaatatggtgctatcaaatgagccaggatattataaaaatggtgaatatggaataaggattgaaaatctgatgtacgttgaagaatatatgaatggctttttaagatttaaacagttaacatgtgtgcctatagatttaagattaatagatgtagatatgttaaatcatgaggaaatcaattacatagaccagtatcataattttgtatataacactattgctccacatgtaagtgaagaagtaaaacattggttatgtcatgcatgtcagagtttaaaaggtaagtagatttgttttataagcactttttgtatgtttgaatatttttgttttttaggtatatctaaatcataaccttatgtatgaaataatagctgtattctattgtaatatacatattttatgatttgctgaatatataaagatctgtctttttatatagagatgatggtgcttttagtaggtatgatgcacattgttgatatatataataatattttaatttaattatattgtataatcatatgataatatagctttttgttctaatttatattctaaagtaatgtaccagagacattgttttataactttctataaaaaatatttccagaaaataaaaaatgctttttatagcgtggtgatttttttaaatgtactatggtattaatgaaagcaatgatttgttagtaggttggtcagatgtttttatggctttccaacaagcttgttttgcagtacttgcgattttatcactcatagcgtatattgtaatgtctcttgttttgtcttgaatattgtgttttgctattaattctataagtattttagcagttcttgatgaataaagtagtatacctgatattttgttttgtaataaggcattataacaacatttactcaagtattttctgtctattgtattatatagtataatctcttgaaagttatggtaatggttaaaacttttttttaagttatatgtaacttctttgcctcttatgtataatatattagctctgttgtggttttttatataagatataacgttatcaatatttccattgagtgattttacagatgtaaatcctaattcttgtgcagtattcatggtattattaccgacagtaacaatgggtatattccaatttttagtgatcttgctcaaagcgattatgctatgctggcttgtagatatgattaaatcgaaatcgtttatattgattttagttatcaggtattttattgaaaacagtggttctatgtagacattaaaaccttgcttattaagatattccttaattttgatagaatctttttttggtcgagtcactaataaagatttcatagaatagattatgtacttaattaaaaaaaatatctcagtatgtgtagacaatcaacttaatatttagtttaagaaatctatttagaaatttattgagtgtaagttaatgtataaattacaaatattatgattaataatgtgaaaatttggctaattgtggtagtaaggtgatttgttctatagatctagttttcattttacattatattaatttagtagtagctttaacacttatattaagtatatcattaatttattaataattatttgtcaataatttatactatgttataaaaagattattgtatgaaatttatatgtagaatgaagtatgctataattatagttttattttttattatcttatttattccgtgtacatcagtatcagtgggatgtgtaagatatgatcagaaggatattgtagttggattgatatctactgagtttattagttaccctaatgagtataaaacggctttgggaattacacaattacttcagagttatggtgttcgtgtagttcttatggattataatgtaattatgcagttagtgaaagatgaaatagtaaagattaataaaacctataaagcaaattgtaagatatcaagatacgatattatagaaagtgtggttctaaagtttatagaagagcataatatcaatagaatatttataccaggaaaccactataatattagttctttaccaattgctccgtctttagatagacaattggttactaatgctgtcgttaaaataattcataatcaaaatcattgtatacatcttcttggtgtttgtggtggtttacaaggtataatgtatgcaaatggaattaaaatcacaagggtgaaggatatagttaattctgatatttctgtgaaatcacatactgtgtcaatgcctgatcctagaagtgtgtatgctaatttacataaaatcaaaatttttcctaacactaggttatcaaatattgcagttgatttgaaattggctaaagatcaaattatatattttccagatgcacattcagaagcaattgatagcaatgtagagaatgtgatgaaaatgtataatttgggatataaaattgctgctatgtcggaggatggtgttatagaggcgatagaggataaatatggtaatatatattttcaatttcatccagagtacttaatgattaatgccgaaagaaaatttggggacaatacaagtagagatacatcaattatgcttgcggatgcaataattaaagattttctttttcgtgattgaagagatttagagataaacaaatttatattaacgagtgcgtattttgagtaaatatgtttacttatctagtatgatgtgatttttgactttggtataagtagtgaaggagctacttgtttaattatatttatgttttctgtatgtattgatagtatagtggtttttataatgttattagttttgtattcaacagtttagtatttaaaaaaatgtgtagttgaaagatagctttacaagtaaaggtgtaaattttgattcttttgttataataaaacagctctgttatttaaatgtttagatgatagctgaaattttacttccggtaccgattaataagacattttattacactattccagagaatgatatgttctgtgttggtgaatatgttcttgtaccttttggagctagaaccttggtaggtgttatattgaaattgaatgatatgataccttcagattgtaatgtagaaaagttacaattaaaagttgtaatttctaaaaattctttgccaagagttaatgttgcgttacttaattttattaaatgggtgagcgactataatattgttccagcaggtttagtattaaagatggtgttcagtaatgtagtaaatgctaaatcttttagtaagctaaaattttatgcaaaacaaaatgacagatgtaatagtgtagaaattaatttatctaatgaacaaaggattgcatataatagtattgttaataagatttcaggttattcagttatagtattagatggggaaactggctctggaaaaactgaagtttattgtgaagttatacgtgaattaataaaaagggatagtacagcacaagcattaattttacttccagagatagtgttaacattgcagttaataaagcgtataaagcattattttgatagttattatccagtagaatggcattcaaatttaacattaaagaatcgtaaggaatattggttatccatagcatatgggcagtctttgattgttataggtgcaagatctgctttatttctaccatataaaaaccttaagatgattattgtagatgaagaacatgattcatcgtttaagcaggaatgtggagtgctatataatgcacgtgatatgtctattgtgttggcaaaaaatttggatataccaataattttgtcttcggctactccatctctagaggcgatcaacaatgtattaaagtctcagtattatcatgtgaaattaacgcaaaggtttggaaatgctaaattgccatcagtgaggattgttgatttatgtaagagcaagatggtcaatgtgtggttatcaaataaactttataatagtatattggaaactttgcaaaggcaagatcaagttatgcttttcttgaatcgtcgtggatatgcaaaattgagattatgcaaagcttgcggttttaaaataaactgtaaaaactgtgctacttggcttgtagaacataaaaagaaaaacatattattatgtcattattgtgggtattcttgtcccatgcaagatgagtgtactaactgttcagataaatcttctcttatatcatatggggtaggtgtagaaaaaatagcagaggacattgttgcactaataccaaatgctaaagttgcgataattagcagtgatattagtagtaaggatgtaagtgttatgattgatatgattatgcgtaatgaggtaaatgttattattggtactcaagtgatagcaaaaggtcataattttcccagattaacgttagttggtataatagatgctgatttaagtttgaataatagtgatttgcgtgctacagagagaacttatcagctgttgcatcaggtatcagggcgttctggtagatttgcagataacggtgaagtaattttacaaacttatgataccaatagcccattgattaaatcattgtcatcttataatcgtgaattgttttatagtttagagctagaatctaggttattaactaaaatgccaccatatacaagattaataggtataataattagtggtaaggatgaaactcatgtcataaatgtgtcgaagcaaatagtaaagagtcttccccatactttgactgttttgggtccagctcctgctcctataagttttttaaataggaaatatagatatagaattttgattaaggtacagcataacgttattatacaaaaactacttgctaagtataaggagtattatgcaaaagcaaataaaattaggattactatagatgttgatccagtaaattttatgtaaattgttattgggtatagataagacaataagttattgttaatgaatattaagagatattgcttgtagcatgtaactaacgtgtaattcagcaaggtacattatatttatagtaattagttattttgaatctcaataatctgaagaatttgtgtttgactaatgttgatgtattgttataatgaatgcctgttagttagtgttttaggtttgtaaaatgagtagggtttgtgatattacaggtcagggaaagtcttttgggaataaggtatcacactctaatcgtaaaactaaaagggcttatttggttaacttacataatgtaactttagtaagcgatattttgaataggaagtttaaatttaaagtatctagtcgtactttaaggacagtaaattataagggtggtttggatttatatttgcttaacacatcgtctagaaagttgactgataaagctcaaaaaataaaaaaactagttaaaaatgctgtggcaaaaggtgtgaaagtttctttataatttgaaactcaatttgatgcactcatttctataattccttacttttatttctaagctaagtcctctatttaatataaagtatcaagtgtaagtgtaataaaaagaggaggagtgtatagggtgttgtttgttcaatatgattgtgagtaatatggcagatatgagtgggtaaaatattgtatatcataaactgtaggtttgtaagtacgttttttaaatctgaacttagtgttatttgtgttgaatggtaaagttgttagatgtttgctttttcctaagtaatagttattagagcaggtatttctatataagtgtgcaagatttttttatatctggtttatatttcttgagcaggtatacttgttaaatataaggttataaatcttgcttatttaaaaataaagttgttagatgacagctcttgtttgagtaatagttattagagcagggtattctatataagtgtgcaagatttttttatatctggtttatatttcttgagcaggtatacttattaaatataaggttataaatcttacttatttaaaaatagtattagtttgttttctggaatgttgatgtaaagttttttacctgatgcataattgtattgtatcaaaaaatatatctactaatgtgaccatagaagtaatgtaatacttagttgtatctgaatattagtgagattttttctgttttaattcatacttgttgtgttatgtaagtatatgaataaggttatcagtaaatgttctttcctaagtagcaataccgattaaaattttataagttttaatatctgtttcgtgttatgcaatagtgctaatagtgaaaaatatacttattggaaggatatttaatcacatatttaaaattctaatatgatctcatcttttaacatgtcttcataagtttgcctagaacgaataatgtcataactactgttgttaaccattacttcaggtattaataatctggagttatagttacttgacattgaagatccataagctccagctgtgcatattgctactatttctccgttttgtaaattatgtatatgataattatgtgcaaaagtatcatcagattcacatatagggccgactatatcgcatggttgtagttgtgttgatgttgaagaaattgctggtattattgtgtgttcagcgttgtataatgctggacgtattaggtcattcattcctgcatctaatataatgtgacttttttcttgattatatttacggtatagtacttttgttaatagtataccagtatttcctactaatgctctaccaggttcacatatgatttgataattttcattttcaaaattcttttttagtaagtttgcatattcttgaattgttgggaaggtatcagaacttttatatggtattccaagtcctccaccaaggtcaaccctgataatttgagtattatgttgcttaaaaatttttataattttttttattttgtcaattgtattttggaatatgtgtagattggaaatttgtgaacctatgtgtacggatattcctataattttaatccaagtaaagtctttattgaaaatttgatcaagtaattcttctggtataccaaatttattaactttcaatcctgttgtgattttatcatttgtatctgcattaatattcggattaatcctaatagatactggtgcaattatatttttttgacatgctattgtatttatgagagataactcttcaatagactctacattaaattgtagtattctattgtccaatgcgaaatttatttcttgctcagtttttcctacgccagagaaaactattttatttggtgaaattccagctgcaatagcacgtcgtatttctccttcagatacaacgtctgctcctgctccaagtgaatttaataaacttaaaatagataagttagaattcgacttaactgcataacatactatagaattattaggtagattttcttggaattgtctatagttattttttattgcatttaaagaatagcaatagacaggggttccgacattttttgcaatatccaatacatttacgttttctatactgagtatgttgtttttataatgaaaaaatggattagcaagaaagatcatacaacgctccaagttttagcgatttaaatttatataatattcctaatatataacataaatttataatcatttataatattctattacaaattaaaagttatagtttgtcagaataatatttaaacttgtatatggagaataatgtcatagtaagctaataggatgttgataaatataagaatttatactttatatagtgtaaagacctataaaaatgtggaaagatttggctactatagagctatttaagacagtatatttgatcagtaaacattgtttattggcttaattgttctaattcgtcaattagcatttgtatatcattaggaatgtaagaatgaaattctatgtatgtgttgctcgtaggatgagtaaaccctaatttataggcatgaagggcttgtcgttttaatgtattgataatggtactttgtttagcatattttacacttttactgttgttttttccgtatttttgatctcctattatagagtttcctatgtaactcatatgtacacgtatttgatgtgttctacctgtatgtattctacattttattaaacttgctatgttactgaagcttttttgggtttgatattcagttattgctaatttacccttatgtggtaaatgcgtcacagtcatcatttgtttattattgggttttacacagatatagtttttgatagtattacttttagggttaggtaacccccatactactgctaagtattctttttttatttgttttttgagtagtagatcagataaaaaataatatgatttttcattttttgcaatgaccattagtccgctagtatccttatctaatctgtgaattattcctggtcttgttgcttttcctacatgacttaaactgttgccgtaatgtgcaactagtgcatttactagtgtattattatttgttcctgctcctggatgtacagttattccaggggctttgtttattattattatatcatgatcttcatatactactgaaattggtatgtagtgattaggggtaattgtgtcactgattgtttttataggtatgcttatattataaatgtcatttacttttgttatgtgattgttgtcccttattatggtatcaaaaagtagaattttactgtcttttattagttgttgtacttgattacgagatatgtttaatttacttgctataaatttatctaatctgttattttcatctccacttttaataaaaatttttttctctagcatttttatattataatttatgtcgaagtaatatactgtaatcactagttatagtcaaaatagtgaaatattacttgtggtatggttgtatataagtaaaattttagactatctttatatataaatgaaggaattaccttttaattaagagtatttaagataatgataaaaaaaatattaatagcaaatagaggtgaaattgcatgtagagtaatgagaactgctcgtaaaatgggaatatcttgtgtagcagtatattcaaatgcagatgtgtactcattacatgttttatctgctgaagaagcagtaaatattggtcctgctccagtaaatcagagttatttgaatatggagaaaatttgtgaggtagcttgtaatacaggtgtagacgctgtgcatcctggatatggttttttatcagaaaatgctgattttcctgaaaaacttgagcagtataatattaagtttattggtccaagttctacctcaatcagaatgatggctgataaaattacttctaaaaaaatagccgagtctgcaaaggtgaatattattcctggatatatgggaattgttgattctgttcatgaagcaaaagaaatagctaaatctatagggtttccagtaatgataaaagctactgctggtggtggtggtaaaggtatgagaattgtgaagtcaagtgaagaaatagagcaagcttttacttctgcaacaaatgaagcagcaaaaaattttagggacggtagaatttttatagaaaaatacgttgagttaccaagacatattgaaatacaaattatagctgataagcatggcaatattgtgtgtttgggtgaaagagaatgttctatacaacgacataatcaaaaagttattgaggaaactcctagtccgtttcttgacgaagaaacgaggcaaaaaatgtatcagcaatgtgtgaatcttgcgaaaaaagtagggtattattctgctggtactattgaatttatagttgatcaagataagcaattttatttcttagaaatgaatactagattacaagttgaacaccctgttacagagcttgtgactggaattgatattgtcgaagaaatgattcgaattgctgatggtgaagaattgagatttactcaacaagatgtgaaatttactggttcggcaatagaagcaagagtttatgcagaaaatcctacaaagaattttttaccttctagtggaagaattgcttattattctgctcctatgcctaatgataatttacggattgatagtggggtatttgagggagcagaagtcagcatgttttatgatcctatgattgctaaagtttgtacttatggtaaaaatagagatgaagcagtgagttttatgcaaagatatttaaatgagttttatattggtggcattgctaataatatagactttttgttatctgtatttcatcatcctgtatttatatctggaaatattaatacgaagtttattgagcaattttattttgatgggtttcaaggaaatcctctaaccaaagcttgtattaaactttttattttgacctcactatgtatattctttcaagatgaatatggtattcatggggttgaattatgtgaaaatagagaattagctgtttatgttgatggtcaaaaatatttgattagtgctaaatatgaaaatggtagagttttggcaatttatgaccagtgtgagtatttagttgtaagtacatggaatgtgaattttaaaatattacagatccaagtaaataatgatgaggtatttcatgtaaaggttgatagtagattaaataaatatcaacttaaatattctgctatgagtgcattgtgtgcagtatataaaccttgtgtatctgatctactacctataatgcctcagattagtggggaagagttatattctagtaatgtatgttctcctatttctggtatgatagttaaaatttatgttaaacaaggagaagaagttcaaccaggtcaacctttgttagtaattgaagctatgaagatggaaaatgtgatatattcagatgtaaagtcaattgtgaaatctgtattattttcagaaggaaacagtgtagctactggtgatgttattatagagttttagttggttatatttattttttattgtataaagactgcttacaccttaatagtatagattttaataaattaatagatataaattgtgattgtgctaaaatacgattacaagtttttgtaaaagtaagtcgttatagtcttataaaagtttaagtatatttagacggggggcgtatatttttagataattcatataaagtaaaattgtgattatctaagtattgaggtaatgtatgttattaagtagtacatataaaagtcaatcgctagttgatttcctcagttccatgattcaaatagataatgtgagattggagaaccactttttatacattgatataatatataacagtgatgatgacagaaaaaaaattttaaatgttttacctcgtggtgttattcaggaagatctagtagattgtagattaacggtaaaaaaatcagatttaattttttttaaaacgcaacttcataatccttttcgtgcgacagctggtaataatgaatataacatcagattaatgatgtatttgatatttgaagcaacagatctttgggaattacactgttgtgatatttatagttctataaaaggtcattatcagcatgatcagcgtgaatgtaaaggaatattccagcaattgatgagttatttctttaaaagtaaagaatgtgttggaagaatgggtgaagattgtgtaagggatttgaatcctttatgttttccaaacccggagttgttaaggagtaagttatgtatacattctgatggtaaatattatgtttttttatctactataaaagaatatgaagatagtgttttatttaaagtaattacaaaaaaattgcaaatgctggaattagaaagcgctaaatcatctgatgatagtgtattattaaaaatattggatcagaaaaaatgtttgcagtattttattgcttgtctgtcagacgtaaattgctttaattcattagcggtaccatttcatgtatttctagaggcgttaaatattttaataagtgatcaggtaatagtaaaagaaattgaaggtttattaagagaacgtcagctacatgatatgataaatcatgttgcttataagttttttcaagataaaaaacaatatggtattgatgtatatggacaagggttagagaaagcacatgatatatattatgaattatatggaaataatttaccggaagataatttagcagtgaaaaaagctatattgagtttacaaaatgtgaagttcaatattacagcaaatcttgatttttttattaaaatgaatagtgataaagggattttacgtgctcaacagtattttaggggattgactgcacttgtagaagcagagattaattttttgcagaagttccaagatgttttagtaataaaagatttagatttgtttttaaaggttacttgtaaaaatgttcatgatgatattaatcgattgcttgctgcatatgatttctttatgcagaaaaagattgttgacaggaatgcaatattaaaatttacgaaaaaagaactcttggaattgacacaatataccaatagtagggtacttttgttgaaagaaattgtcaggtatatgaacgatagtataagggcaaagaatataaacaagagttttcttagcgaaagagttattggttttatagtagataatcatccaatattaagtacacagttgttaaaagataatcgattaatatcatctatagattttcctggattaattgattcaatagtgtgtgttaatggaaagtggataataagaaacaaagagaaaaataagtggcttttacgtcaattaaaattgcattctttgatagattacttagatataaacatagactgtttggatattcttgatgaattatgggataagaaaataagtgatagcaaatttctcggtatcttacgagttattataaacaatagtcatacagataaaaaatttatttatgatgttaaagttagtaaatctttgagagtgttacaagttttatatagaatttcacattttataccattttcttctatatggcgttattatattaatcctagtcgttatcgtactacgccaggttatgtaggtgataatgttaaggaaaaattatatacacaaaataaaaaaattcctgttacatcattttcaagtaaaattatagaaaatatcaaattatgcaattctgaagaaagatatgttcaaagttattatgaagctaagtttttaaagaaaagaattcgtaaggacaataatatagcaggaagatttgaaaagctgaaaataagactattatctaataggtttgtagcttatgtactttttggtcttatgtttgttatcatactgataagtgcaattgttggtaggatacttatgcattttaatattataccaggtgtttttattggtaagtttatttatggaatgcaggggatatttgattcgttgtgtgtagtagtagggttggatactatagtagataaagggttaagtttgattttagatactgcaggtattattgttagggtacttgattttattttgttatgtggtttgctctcagagtgtataaggttttttataaagttggtatatttaatatgtaagcatgtttataaggtatgtgaaaacatttatgaatttttgaaaatttatgggtttaagtattcatgtattattttattgagtaagatttggtttattaagcatagggagtttgagacctgtcagcaacaaagagaatctagtgaacaggggtatgatattaatggtggtttgatagaagcattggaacagatttatggtaaggtgaaggtcagtgatggtctatcatcacgcattattagtatgacacgagagctatcttcgcagattgatcagattctatgttgtaataagcccaaacctgagtttttgttaaaagagtttgaaagtcatacctctaaattgcctcaggatgtggtaggtaatgtaaattatattaaattaaaatatgagttttcttatttattaaataattatacagaaaagattaactattgtagtgatacagacaggttgaatattctaaatagttttcaaaagagatcagcactttatgacaagattactgctgttaatttacagaccagatattttcataaggattcatgcgttaaaatatgcaatacacgagatgtagagcgtatatttgctgaagcaaatactatgggtgatattgtaacagtagaattattagatgcaaaaattgcatcattaaaatgggcaatacatatgttagatgttcatgatgtttataatatcaaaaatagatcagagccggtattcttaaatactaaagtggaccatagtatgactgtagtgctttatgattgtatattaagattacagaattaccgcaaacaactgcaatttggtaaattaatttctaaaaagtttatagatactgatattgatagtaatttttctccatatataagggatgtatatcatgttttacagtcactggatgataatagtatgcttaacagccagacatcaagtataagaatatttgttgagaacttttttgattctaatagtttattattaaaaaaaccttcagataaagctaaagatttagctaattatattaaaattgataaaggaacagtatcttgtatgtcccgtattaaaaagtctatttatgaatttatagaatattttcaagatccaaagagcatttctatatcttttatattgtattatttactccgtttaacaaattcaataactttacttagtattgctgattatgttacacaaataacggatcatgcgttagatatagtaatgttagatgggttatatgaatattttacttgtactgattttggtaaattattgttagttgaattttatcaaaaaggtattttgtttaaagatataatgtttatgtgttctgaatttgatttaggattgctgtataataatatacaaacagttcaaggtagtttgcattgtcaagatattaattactctatatattcatcttcttttcataggggaaatcctgcacaggagaagatatcacaaatgattaatggatttatagaagttttatgtgaagggttgtttataaagggagtacaacaacttgttaattattttaaaaagaaggtagtatataatattcaatactttatgttacatgagaatatggcgtcaaattcagtattgtttaatactaaatgtgtgtctgattgttattattctgctgatgtaaaagtagtgcaggaagtaggttgtcgtaggcaaagaggagagttatttcttagtgatgttgatcataccttggagttaagtattgatcgttagtgttatatttcaagagtccgtttttaaagtgtggatggtatgtttttatggtagatgataaaagttacaaaacaaagtcaagtagcttaaatgggctcagtgaagatgctaatgagaaagttagtgatgttctacatgatgtaaaaacattagcatttagtaatattaatgaggacgatgattttaggtttcttggtaaagttaagttagaagatttagaagtccaagaatctattttggagcttgatggagcatttaataaatttcttatagagcatagtggagaatatagcggtgttatacaaagtcatgaatatgattatgatgcatctgcaggtgaagttcaaaatcttgatcttgacaattttgagatagaagaatctttcttacaaaagatattagatttttttagtgaactatgcgagcaaaatgaagattatatagattttgactatgaacttgatcctttgaagcgtaaaaggaaaaagaaaaaattcatattagaatccattatagagtttttaaaaaggtttttacgtagtggtcgttctcttaacctcaaggagttattagatgagcagatttcagagttgcaagaggaattagttaatgagctggatcctgaacgaaggaaattattacaagaaagattaatgcttcttacagagttaagagctcaaatgattcaatatggaattggttctaacttactctttcgcttttttttatttgcaagttttgtaagttctcttattgggttacaacaggatacttcgtctgctaagcagtatgttaaattagcagaagtacttggattatctttacacaaaggtaatgagaaggttttggatgcaaacagcaatagtattgttgcttctcaaactcttgttgtgactcctccgttaagtttttttgtatatggttatacgttagatgtttttcgtggtaagataaatgatgtatcttacaagttacaagatcagtatttttttgtaagagatgcatcacttcagctgggtcctcaatatggtgtgcaggggattttttttgctgtagctaccataatgaatgcaatagatcaggctttacgaaaagtggcgaatgctgttaaaaaagctgtagataaattagatatttttgagcattctaacaaatcttcaggacttcatgattttgatcgtgttggtcagcaatctcatagtactatagattatgcttgtacagcacgtatgaattttgttcaaagtactgctactgactttcagtgtacgactggtcttttatcatctttaaattaccaccgagagttaaaattttcgtgttctggggtttataataatagttacctagacaatataagtgtagtgcaatgcagtatacaaagtaatacaatgatatatcgtggtcattaatacatataatataacaatacatttatttcatggttgctaaagttttttttacttactaggaatgtgctttaaagattatttaagtgttattatgagttaaatttgtatagcgtttatattaaaaagaataaagtggtaatacagttaaaagtttaaatgtatataataatctttacaacatttgcgattagttacaaagtagtatgttttgatgtatatattagtttttattgtttaagttaagggatacttgtctataattttgagtaatttttttattatgtaatatttatagcagtatgcaaagtagtacaatgatatatcgtggttattaatacatatatataacaacacatttatttcatggttgctaaagtttttttttacttactaggaatatgctttaaagattatttaagtgttaattagttaaatttgtatagcgtttatattaaaagaataaagtggtaatacagttaaaagtttaaatgtatataataatctttacaacatttgcgattagttacaaagtagtatgttttgatgtatatactagtttttattgtttgaattaagggatacttatctgtaattttgagtaatttttttattatgtaaatttatatattataacatgcagtagtgtaaaatatacacttaataaactgtaagtggtatcaaatgttatcctttcttgacattaataccactgttatttatactcaactaataagaatttctaaattttactgtatgagaagtaaacctgattggttaaaagttaagatgcctacaggggatactttttatcaagttcgcaatttaatgaaattgtataaattaaatactgtgtgtgaagaagcagcttgtcccaacattggtgagtgttggaataaaagacatgcaacagtaatgattttaggttctacatgtactagagcatgtgcattttgtaatgttgtttctggaattccagataaactggatcctcatgagcctcaaaacttagctaaggctgttggtttacttaaacttgagcacgttgttattacatctgtagacagggatgacttggaagatggtggatctggacattttgtagagtgtatagaagaaatacgaaaaaacgatcagaatgttactattgaagtattaactccagattttttgaataaacatggtgcaattgaaaaggttgctgatgctgctcctgatgtttacaatcataatatagaaactgttccaaggttgtatgcaaaaattagaccaaaagcacgttactttcattctctttatttgttaaaaacagttaaatataaaaatcctaaagtatttactaaatctggaattatggtaggattgggtgaaacaaaagaagaaatatatcaagtaatgaatgatttaagatctgcggatgttgattttataacgattggtcaatatttgcagcctactcctaagcatgctgcagttgataggtatgtaactcctgaagaatttgatcattacaagtatgttgcatactctaaagggtttttaatggttgcgtcgggccctttagtaaggtcttcataccatgctggagaggattttcaaaggttaaagaaaaatcgtgctgctatgttcatgcatgctaaaagcaattagaattaacatggtagttaatattttttagaagtttgaatgtttataccagaagggtttttcattagttttatatgatatttaattttttagatagttaatcggtagtgtagttggttgtaatctgaggaaagtttttgtgattgagagaaagtaggctatacatattagaagtaaattttttgtatatttaatagaaaaatagaatctagatataaatctgattatatattatgtgaggttgaggtaaaaaggtaaacgttgagccatttttacaatggtatcgactaatatattattttattataaatgcttgtaagatttcttaatacgttttataagtttgatatcgcacttatagctcagtggatagagcgttaccctccggaggtaaaagtcgcaggttcaaatcctgctaagtgcacttattttttatgttattataaaatattaatgtggagcaacaatattgttgatgttatctcttttttcatagtttggtaatgatagtttagttaatgttgctttatgattattaatatatatggggaattattatttgtaatgtattaattgaagagtgaatcattgaatttaagtattttaaaaaataaaatgatcaaactttttccttataaaagttactataagatttagaattaataacattaaaagtagagctactatagcaattgcagctaattggataaattcaatatgtggattacttgcccacatatatatttgtacaggtaatacagttgttggatcgagaaaatcctttggaatatcaactatgaatgctaccatcccaatcattattaacggagaagattcacctaagattcttgcaatacttaaaatagcaccttgcatgatactaggtaatgctattggaaatgagtgatgtagaattacctgcatatttgatgctcctagtgagaaagctgcatcttttacggatggtggcactgctgcaaatgcttgttttgtagatgttaccaaatttggtaacatcattaatgatagagtcataccacctataagtgctgatgaacgtggtatatcaaaaatattgatgtatattgctaaccctaaaatgccaaatattattgacggtacagatgcaagatttgttatgctgatttcgataatagaagatattttattttttggtatgagctcacttaaacatatgccggatgtgatacctataggtaatgcgaatgttaaacatataattattgtaaacatggatcctattagtgagccaagaatcccagtattttcaggagatctagagttatattttgtaaacagtgcgtcattaaatgatacttttatcctgttttcattttgtaattttgcaataactttttgatatattgcatgatttatgtttttgtttttgatagctttattaaatgtagtggaagattgaaaccatatgttgaatttagtggattttggattcttaagtagaaaatctgctaaattatgatgagcagtatcatttattatattataaatgatttttctattgtcaggatttgaaagatctataacatttgaaaatagttcctctaaggattgatgaataaaatatattagattgtttctcaatgttagtttatcttgttgttctatagtatcattattgattgtaattgataataaaatttttgttgttgttagtgcattatatccattgttaacgatacttcctaaaattataaaaagtatacctaaggaactaacaagtgcagtcattgataggattgataagatacgatccttcctattttttaaggatatacgggaagcaatatgacgatactttagtaatttacctaatttttttcgtatgtgcatgttattataaatgttaacctttactgtatatagttttttaattctatctgtgattttttcttattaaaagtatttttatgtaaaatggaaatatattaatttggcatagagttgaattttagtgtactcgaataaatattatgtaataattcatgtacatcttaactttgcgtagattttatgtaaagttggactttttagttgtgtttatttaatagaggacatatgtttactttaccggaacttccatatcaacaagatgatttagtgccatatttaagtcttgaaatattagggtatcattataataagcatcatcagggttatgttaatactttgaatactcttgttacaggtacagattttagtaagtgtactaatgaggatttaccaaaagttattgaggttacatctggagatttaggatctagagctatatttaataatgctggtcaagtatggaatcataatttttactgggaatctatgaagaaaaatggtggaggatctcctacaggaaaattattagataaaataaatgaggattttgggagcatggatggttttaataatgcttttattaatgctggaaaaagtcattttggtagcggatgggtatggttggtttttgatgtaaatgagcagaaattgaagattgtatgtactagtaatggagatactcctattacacaatatccaaaaacacatcctttattaactatggatgtatgggagcatgcttattacttagattattttaatgtacgtcagaattacgtagaaacttttttacaacatttagtgaattgggattttgcagctcagaaatttttagcaatttaatttattttttattgttaaaggtaatcgatttgaagacacatatgaaattttaactatgttaagttattacttttctaaattttgagatattcttagtatttttattgattatttagtttatagatattaatttatttaatgttggttaatgataccttttagttttaagttaaaaggtatcatttttaattatatcataaggaaattctacttatgcttttatttcaattacaaataaatgttgagaattaatggtttattaaattgttattgttacttttaagattaatgcgtatctacctttaatggaaggggtttaatataaaataaaacattgccttatatgattgcaattggtgtttagattatgtaaatatatttaatttggtatttattatggcaggtactgttaaagcagatcagttatttaagggattaactagacctacgatgctttttggtgttagttatatatttgcaatgttgaattttatgatttgtatcatgatatttatgtatactaatgattttcgtgcattgtttattttaggtccaggaatacattcagtgggttttttagcttcatcaaaagaaccattattcttggagttatttatgctgaggatgaagaagtgtagtaaatgtttgaatagattttatcataatgctaattcttatgatgtaatgtgatgttaaaatttcaacaattgcaaacgaaaaaaagaaaagtaattaagagggaatatcatgaatctaattttattccctatagtgaacattggaattcttctacattgatgacaaaagatggatctatgcttaaggttattaagttgtctggttatgcttttgaaactgcagatgatgaggatttatctatacaaaactctatacgcaatcaaatgttaagaagtatatcttctgcatcttttggcttatattttcatgtaattagacgtagaagaaatgctttttcagaagggtttgcaagcgataaagtgtctagttcgtttgccaattatgtaaatgtaagatggcgggaaaaacatgcaacaaagcaatcttttactaatgatttatatattacaatagttagagaaggtggtaaaaaaggagtagaatttttatctagtatttttgataaatttggaaaagttgcatcacaggactcatggattaaagatttacaggctatttctgaagatttagatgaagtaactaatcgtgtttttacaagtttacgtaattatgcacccagaattttaggtattagagaaacaccaaagggggtgttttctgaaattatggaatttttgttacaggtagtaaattgtgggtcttttcaacgtgtattattccatgtggggaatgtatcaaagtacttacctatgcataggttatattttggacataaaacaatacaaatagttgcgcataatgaatgtaaatatgcagggttaattagtttaaaagaatacggtcaaacaacatctgctggtatgctagatgcatttttacaattgccatatgagtttattatcacacaatcttttaagtttactaacagacaaagtgctattaccaaaatgcagattcaacaaaaccgtatgatacaatctgcagataaagcagtatcacaggtagtagaaataagtcaagctttggatgatgcaatgagtggtagaattgcttttggacagcatcatcttactattttatgtacagaaagaagtctcaaaactcttgataatgcattgtctttaatagaatctgagttatctaactgtggtgtatatccggttagggagagagttaatttagaaccagctttttgggctcaattgccaggtaattttgaatatatagttcgtaaagctataatcagtacgttaaatatggctgggtttgcatctcagcataattatcctattggaaagaaatttaacaatcattggggagaagcagtaacagtatttgatactacttctggaactcctttcttttttaattttcatattcgtgatgttggtcacactgcaattataggacctactggtggtggtaagacagtattaatgaatttcttatgtgctcaggctatgaagttttcaccaaggattttcttttttgataaagattatggtgctgaaattttcattagagcattgagtggggtgtatatggttatagaaccaagacatcctacaggattcaatcctttgcatcttgatgatactccagataatcgtacattcttaatggagtggataaaatctttaatatcggtatttaatgataaatttacttctgaagatataactcgtattaatgatgcaatagaaggtaactttaagttaaaaaaagaacatagagtattgtgtaatttagtaccatttttagggttggatggtcctaatactttagctggagctatatctatgtggcatagtagtggatctcatgcagcaatttttgataatgcggaagatttattggattttaataaatcaagagtttttggttttgaaatgagccatttattaaaagatccagtatctcttgctcctgtattgttatatttatttcatagaattagtatttctttagatggtactccatctattattgttttagatgaagcatgggcactaatagataatccagtgtttgcaccaaaaataaaagattggttaaaagttttaagaaaattgaatacatttgtaatttttgctactcaaagtgttgaggatgctagtaagagtgcgattagtgacactttagtacaacaaactgctactcaaatatttttacctaatttaaaagctacgagtgcttataggaatgtatttatgttaactgaaagggaatatacattaataaagcatactgatccaagtacaaggttctttttagtgaaacagggagtaggtgcagtagttgcaagaattaatttgagtggacttgaagatataataagtgttttatctggtagggcagaaacagtattaatgttacatgatttaataaaagaagtaggagatgatccaaatgtttggttgcctatattttatgaaagagtaaagcatgtgtaaatttaataattaagaatattctttataaaagagttgattatgctaaaagttagtaagagtataatatatgtattaatgttatttttgattaatgttaattttatatgtgctaaatctacgttagcagcagaagttgaaagtgaaaaagtagctgtatatagaactacaattgctagtaatcctttatatgctaaagtaagtgaacatgctaagtatataggtattgctggatttactgctggatttgctcttattattggtagtatattctttctcaaccctgcaacttggtatgtagcattagggatgtttcttgcaggtatggcagctattgcttttgctgctgctaaagctgctccattttttgcttgtaattggtcttttgtgcgtcatccgattatgcgtttcgatactcatgatgcaaaaagaaatggtaatactgaaggtagttataaagaatgtgaagagcctactaagaattatccagattgtacgaatcgtgattttggttcagaggaggaatattttaggtgtcttgtaactggtgataaagatagtactaaacctgttagtataaacaatgctaaacaaaatgaacctgtatgtgcatctcaaaagtttaaaaaagtagataaatattattggcctaaaaatagaatatctagctctaattatatagaagtgtgttatcgtaatcccataggtagccttaatcctatcactatgattaaaagagcatcagaagcttcatcgggtaatgttactgaattattgaaaaaaggagaatatccaagggaaggtgattactctactcaggaaataaaagttgctaaatatgctatgcagggagaagtaaaatgtgaggttttacaagctggtcaagaaaaagtgatacatacgattacttttcaggctgtagaaaaagcagataagttatgtgtttatgctactaaatctataggaattcctttgtggcctcaagttgagattggttgtcatatgcgccccagtggacctccagttccaatgtgtgagaagtctacaccagttatgtcagatgataataagaggattgtaagttatgataattctaaatgttatagttgttatatagatcctgcatgtagaggtgaagttggacctcatataaaatctgtattcccaatgacttcaataatagtttcttgtataaaagggtccttgagcaatatattaactggtcaatgtggtcaaaatgctagcaaaaaagttggttttttgaaagttgctcaagataagttaaaaaaggcagtaatggcagttttagtattggccttaatattatttgcaataaaagcagcattgggtgggatacaaagtccagctgaattgtatatgttaataattaaatttgcattggtagtctactttactcagggatctgctatgtcacattattatgatcaaatagtaaagttatccataggattatcagatatggtattgcaagcaggtggatcacaaactatatgtgattatagtcagagtgattacgaagataaatataaatatatagctccatgggataggttagattgtagagtattgttttacttaggacaacaagtaaatggtggagccgcaacaattgttttaggggtacttttgtcagcgggtcttttctttgctactatgctgtttaatatgaaattgatgttatgtttgattgcaatttttgcagtaataatgcttttactaattatgatatggttagtttatatatttttattatcgcttattgcactgactattttgatattaatttctccattaatgattcctatggtgttatttcaagctacaaagggattttttgatggctggataagacagttaatggtttatacattatatcctgtaatactttttgcctttctagcattattatttactgtttttgataatttatattttgaggatcttaaatttaagagaaaggaagttaatgttttaggtcagaaaagaattactttcacgttgaatgatccaagagagtgtgatgatccaaaatatgataataatttagcttgtatgtttggaaatatagaatttattacaaagcctgcattttttggatttaatgcctatgctcctgattttaaacatggagctgagatgttatggatgaaattgctcatgatggtattgataggctttttattttatcatttcttatcttctattgcttatatagcagctgaacttgcaggtgatccaagagctggtcatgttggatcatcatttactccaaagtcgatgttggcttctattgtgggtcttgcagctaaagttcagggtagtgtaggagaacaggcaaagaaagctataactgataagttagatgatcgtaaaaaatctgcatctgatgggggaggaaaagatgagctttctggaggaagctctgaaggagctggtgatgctgcagaaggtgctggaggaggtgctggaggaagtggtgctgctagtggaggaggaggataaaaatgtgaagtttctagtaagtgctgatagaagctagaaatactccttattcaatatgatattatttttgatgtttagttatggagaaagggattaagtaagtacttttgttaaagtttggttatttatgaaaattttatcaagatatttgatttaatgtgattatgttatttttttagggtagaagagctgattttatgtttaaaatagttttgataatcagtatttttcttctttcaagttgtggctatcatggttgtattaaaccgcagagtgtactatttgatgaatattcaactactgtagaagctggattagaagatgggaaaaaagaacatgttgcttgggttaaatcggatttggtactagctggaagacagttccttactataaaagttgatacagtgaatgttaatttttgtaataatacaaaagatgtggtaaatattttttctagtgaagggagtactcttgattccagtgctaaaaaatttcctgttaacatccctaatataatgaagggggaaaagttaaattttaggttatctccagctttgaaatttactgtggataaagatatatgtaaaaataacaaccctaaagtttatgttcagaatactagtaaatgcatggaggattatcttgatacggaatattatattccggttgataattacgattttcaaatgaataatctcatgtatttgaaagatcgtggttcagcaaataaagataaggagaagtcctggattaattttccacttaaaattttatatcatctagatagaaaaacatatagagatgtgagtcagatgaatatttctaagttatctagtgatcgttatcaaaataataatgatcttttctatctttgtgttacggataagaggctgaatgaatatgtaactaaaattgtagaagatatgttaaacaaaacatctagtggcaatactgcttattcaggagataaaaaggagcaactaatatcagagaaaaaagaatctctcttaaggaagcgggatgcagttagaaagaaatatcaaaaattatatgatgcgtatactgtaaatatgctatgcggaaatttatgtaatattcctggttatgataaacaaaaattggataaaaattgttttgttgtagaaacgaataatatgcttaatagttgtactattgagaaaagtggtatatcagggtgtaatttaaatgaagcaggacaatatagtactgttttgccttttttatatttaacacatgattcaggtataacgaattttattactgttgatgatgcagttaaaaaatggcaggcagataacaattcttcttctgatattggtcttttgactaatcaccagtattctattagtaaagatttagataaaaatctttatttagaattgcgtgtcaaagatgatttagagttaataggtaagtatacaattgaagtaaccaaggattgtagtaatcacgtcaaggatagtttatattataccatatctaaaggtccacctacagtaaaaccaggagaacaagggactacaccacttaattttataaataatgaagatacaatagtcaaattaacgggtaatgatgaagttggtgaactatattttggtgtaaaagataatggagatggttatgaaaataatacaggatattttaatattacagtaattgcgaaaaagaaaataccaaaagtgatttcatatatggtagaacgattgaaagattcactggaaagaggattatacggaacatcatctactaattctggtggtgttaatataatatataatagtattatagaaaatatgcattttattaaaatagtgaattcattattggtattatatatattaatgaatgcactgttttattgtgctgggttttctaaggcttctatttttgaattgttaactataacattaaaaattagcataataatttatgtgattggtcctaatagttgggatttttttaataatcatttgtttaaattattcactgaagcaccaatacaattaatttctataatgacaggtcaagatcctgatactagtacaagttttgaatttttagatataatcttatatcggttttctttatctgagagttggttacagattttagcattattgtttgctggtccagtaggatgggtaagtgtagttctaattttttggggattagtagttttatttctcactatagcaactgcagttattacttatttgatatctattattcttataggattgttgcttagtattgcacctttctttataatttgtattttatttagacgtactaaagcaatttttgattcgtggattaagtctttggtacagacagctatgcaaccagtgataatatttgcttcttttgctcttttgactcaagttatagataatataatatatgctatgtttaattttgaatcatgtgatgtatgtgtacttcgtcctgagtttgacataggaattacgacaataggtttttgtttacttgaatttttgctccctttaggattctctcctgtatcagtttttactgataatgtaagagattcagtgaatagtgatacagttatgtttataggattaccaatgcctattgttaatatattaatatttgtaataatggcaaatgcgacaaagcattttgttggttcttctggggaaatgtgtacatcaatttttggttcatttgctaatttatctatggtggctgagggtgctaaagaaagtgcattaggcattattggtatggatcaaaatagccgtatgcaaaggtcaaggtatcagcaaatgaatgagatgaataatcaagatagcgatggtgaacgtcgacgtgatcctcttgacttgcattcgccttcaagaagtgatgactctaccaacaggacatcacgtggtggtgtatcaatacctgaaaatcctccatctagtttcggtaggtagagtatgaaaaagtttataatattattactattttttgttacaggatgtggggttaattgtattgagggtagtaaaggtattagtgggaattcagttgttgtggaagttagtccaacagtaaagaaagtatcaaaagtattgcagcctaattggattgacactgaattaagagttagtaaggatcaacctccaatgagggtagcagttactggagcgttaaatatgtgtcccaaagattttttaaatccaaaaaatctaattgttccagcagtttcttgtattagtgatattaaggacatttcttataaagatgagtctacctatcaaaatataaaagatgtgtgtagtaatgcttctttgagaactaaagctgcaaactcagagtatttgtcaggagttgcacacactgttagtgcttttcgattaaataaaggggatgcatttaaagttagtttaattcctcgaaaggtgaaagtaacagactgtagctctgctgcattaaaagaattgggtgtcatatactattctgatgatgaaatttttgaagatagtaattgtcagcaagctattccagctgaaaatatttgtcagaatggtgttcctaaattttatgtgaaagtcaatcaagaatgtaaggaatctggaggaatggctggtgcaatacctcgtttgcaaggtactgaagtttcagcattagtagataatacagatactccttatggaaataagattttttatagtgaagatgcgaaaaagaattggattaatgctccttttgtttatgatgctagaataattaaaaatcaaaaagttaatgttgagacgttaaaaaaacattgtacaattattaaggaattgaatgagaagaaaattataaatcatgttgatactataagtacttctcaatttgaatattatcaaaaacaaaaagctcaaggtgatattacaacagatataattaaagaactgatagatgttattaataattttacaacttatgatataaattgtgtatgtggtactatatgtaattctaaatcaaagcttgttactggtaaggaaattgctacgatatcgaactatggttcagatggaaattgtattattagtggtagttatgaatataacaaagatgctacatttgaagaaattagcaaggcaaaattagaagacattagtaagaatgctaataattctgacccaataatacaaggattgactgctttttttggtacgcgagtaacacataaacaagaaaaagatgcacgaaactattattgtttcccgcagaaagttcagggtggttcgtgttatgctgatatttcttcccaaaatattgattcaaatagcttaaaatctaatattagttatgcatatgattctgatgaaagtgttacgttgaggtttgcagtaataggtgaaaaacaaaaatatgcttcatattctggtgggtataacattcatgtagaacgtatatgtaattttatgtacggaaaaaagttatatatgtatataggagataatcctccaaccatatttcctggtgatccaggtactattgaattatttgtacctgatcctgaaaatccagaatctggaacaggagtgtatatgattaacaaagatggttctgaaaaaaaatctgggaaaatttatttaggaatagatgttagaggttatgaaaatcagtttgattatagtagtttaccaggaattgaatcagctaataaatattttgtggatttttttataaaaagatggaatccaaatttttctaaagtatttgttatgattcgggatttccttttaaggattttgtatggtgtacctaaggatacgcaggttgacaatattgcgcaagctttagatgtggcacgtaccagtaaatcacaaggtgcaatacaaagcatatatgctaatcaaactggtgcaggatcattatggagagcattacaagcgttatgtagtctatatatagtttttacggtattaggatatgcaataggtgttgtaaaatttactaagtatgacttgggagtacggattgctaaaatagcaattgttgttggtttgataagtcaaggtagttgggagttttttagtgatcatttcttttcaatatttattcaaggaacaagtgaccttgtagctgcatttaatggtgaattggatggggataattcatttagatttttggatactactttaggaatattattgacaggagaggtgtggattagattattaacattgatacttacaggacctataggatggttaatattttatataattttctgggccttttttgtattttttatgtgtgttattgaagcaatcatagcttatttattgactattgttgctgtggcttttttagcaacattagcacctatctttataacttttattttctttcaactgacaaagacactttttgatgcatgggtcaaaatgttagtaaatttttcattacagcctataattttatttgctgcacttgcatttttaaatcaagttgtgttaacagtgttatataaggtaacaagctttactgtttgtaatcaatgttacttaggttttgatcttcctactagtgctgttgaagaaggtgctccctatgatatttgcctagtgtctgtgttattacctgtaggatattcacctgatttatctattactgaatcaataagagaatcttatgttcaggggaatggtggattgttagggctaccgtttgacattgcatcagcgttaatattgcttcttgcggctcatgctatgagaggatttaagggtatgtctgagacaattgctcattctatatcagggagcgttgctggtcttagtgcaagtgtatatggtgctactcaggctttagcttctatagtgggacgtgatcaagaaacacaaaatataattaaggaagcaatgcgtaaccgtaaatctaccggtaaatcggatgttgatatcgttagtagaagtaatcctaatcctgaaagtaggggggaatctgtagaaagaagtggtggtagtgattctgatttacctcccaaaggtcatgatggtggtttgcggactggtatttctgataaaggtgataatgtgcctcaacaacctcaatcaggtgatgatattaaagaagatagtaaaacgggaagagctagtgagcagttgcataatgatgtgtcacccctaagtagtagcagcgtacttgatactacaccattcacattaagttataatgaaatgcaaggtgctgataatttagatagtaatccatctgtgactagaaatgatactagtgctgatggtacttcaggaatggattcacaagatgctagtagtgatgcaggttcggaattgcatggtgatggtgatactggtaatgttgctactacacaagatactggtgataatgaaggtgatggtgcacaaaacggctcacgtgataacggtgaaaatgctggtaatgcttcaaatgttactgagcaggatactagtagtggtgagaatgatgaagtacagggaggctcacgtgataacagtgaaagtgctgatgatgcttcaagtattactgaacaagatagtagcagtggtgagagtgatgaagcacagggcggctcacgtgataacagtgaaagtgctgatgatacttcaagtgttgctgaggatactagcagtgatgagagtgatgaagcacagggcggctcacgtgataacgatgagaatggtgatagtactttaagtgttgctgagcaggatactagcagtgatgagagtgatgaagcacagggtggctcacgtgataacgatgagaacgctgatgatacttcaagtgttgctgagcaggatactagcagtgatgagagtgatgaagcacagggtggctcacgtgataacgatgagaacgctgatgatacttcaagtgttgctgagcaggatactagtagtgatgagagtgatgaagcacagggtggctcacgtgataacgatgagaatgatgatagtgcttcaagtgttactgaacaagatgctgattctgttagtgatggtacagaagtaagtactagtgatggagataataatcttggtaatgatcaaagtacagataatactcttgatggtaatgaaaatacgtctggaaataatgatactgatgtacaagaagaagcaggcaaagcttctagtgttgttgaatcttctgatagtgatgatagtgatggcagaaaaagaggaagaaaagatattaactttttggatggtccacaacgtaaaaggctttatatggatgaatactctagtgttgcagaaaaaattgcaggtcatgagtcggcaatagcagtggaagaagaatcatatgaaagaggaattgttaagaaacgtggtaaaaaagatcagcaagaatagaattttggaaagttaagtgataatgataaagagtaaatatgtgtaattttattaaaaagggttttataaaattattattacttttggtaataactgcatgtgaatctaatcaacatccagttcctagatgtgtaccagctgatgtctttactgaaactagaacagcttctgtttcagcatattttgattcacgatcagaagattttattgctgataataagtcattgggaaatattgtaaaaaatgatcaagtagtacggtggaaatatactggatatgtgacagatggtcgtccaattgtattaaaagctgaggggatgtggactgcatgggtcaatgatgttagtgctgaaaaaagtgtaagttttggtgatgaagattcggaacattataatcaaatattgtctgttgagagaatttgtgggccttataataaaatagaaaagacttttgttcctgatggtcatagtgaatgtaaggtatcatgtgaactaatcactggagttaaagatgacttggaaagaggggcatatggacctccttgttggttcaaaaatggatatggtgcatatttattatttaagagaccagatgaccctgaaccaaatgaaacgttggatcatatgagatatccggtgtctcctgtaatgcatataggatacaagccattagaattggctggtagtgatgttttttctactaaaaataaaccaattatgaattccctttgtcaaaaggtgcaattggagccagggtggaagatatatgtaaaaatattagataagtattattatgataatgttgggggatatgcaatcacattccttgaaggtgtaaaaacagaaaaacaattttctgtttttgaatgggttcgtaaacaggtaagaggtgaactagataaagcaggtgaacaagtttttagacatctagttggaaacccgatatttaaaaattttatttttagtgtgttaactttgtttttagtatttggggctttagcttatatttttggtatggtacagagcccatttggtgatattattattagaatattaaaaatatcgttagtaatattattgatttctccaagtagttgggagttcttttataaccatttacttgctttatttattcatggtatagatcagattattgcgctaattaatagtcatacaggttcttataatcctaaagaacctttttcttttctggatgacatgatagtaaataaaatattttctccagttatttggaagataaagatcagagcattaatcatcgctgatttttcttcaatatttgctgtatgtgtaattattattgccgtattcatctacattgctttatgtatgtatggatgtgttatatatctaacagcatttgttggtattacatttttgattgggttattcccattatttttgttaggtattcttttttctcaatttaagagcttatttgatggttggttaacacaatgtgtaagttttgctatgcaggcaatattaatgttcactctgatttccctgtttggtgcacttattatgaattattattaccgtatttttgggtttacgacatgttataatgagtggctgaaggtaaagatatgtgtattaggtaaaattggatgtatagttgatcaaagtatttttggatggactccagggcaaacttatgatccaaaagttattggattgacaacagattttaatcttaatgatcgtaagtcttctggtagtgcaagatataaatttactggtggaggtgcatatattgatgttcctcctgatcgtaagcataaggattttagatacgtagattatccttttcttgatccagatgctaaaactgatgggaatccgtttggtgtgactgtatctcaagatagtccgtttagacagttatcttattatattaatgcattactttcttctaataaaaaatatgtagctgcaaggttggtaaaggatatagaagatgagttagatgttttagaaaaaaacggtactataagcttgaacagtaaaaataaagttttacaaattatacagcagagaagaactaaagataattctgagaaaaaaagtgaattagagaaatataaagatgaggattttaaatctcaaataattgatagtattattgctgatgttatagggagtgctgctcaagaacgtactcctcaggaagaattgaataagcaatacgattattggttaatcttaagggttagggctggatatttaatattctggacagaagttggttctttattattagctgcgttattaatatggcagatgcgtgcgtttgttcaaagtgtagcagtatctctagctggcggtaatatgatgtctcaaactattgctagtatgtatgaaggtggattcatgaagattttttcaggaattccagttgtaggtgttgtgttccaaaagattgatcaaggtatagatggcttaaaatttgcggtaggtaattacattactgcagttgctcgtatgcctttaaatgcgttaaagagtattccttatctaggtgcagctgttaaatttactgctggtgttactggtgcattgacttcttcatataatgaatatgataggagttttagtaataactttaagcggttaaattatgctcgagcttttataggtgctcatttaggattttctccgttggatgcattgaaatatttaggtggtcatgttgctggcaaaatgcttggtaatagggatggtggattaattcacaatgcaattgaagatcgtaaagctgctttggatagtttgaaagcacatatattaggacctgagaaacatagaccaagcccttatattcctaataaaaagaaagaaacagaggatgatgatgcaaggaatcctttttctaaagaaacagtaggtaacaaaagtggtactgtatcaccagatgaatataaaggtggtgataagaatcatattattagggaaggattacgtagtgaagctggtagtgcattatcagatgattataaagatggtgataagagtcatattattagggaaggattacgtagtgaagctggtagtgcattattagatggatataaaggtggtaatgggagtgatattattaaaggaggattacctactgaaggtagtacattattggatagatatgggaatgtatgtgtaagtgaagggaatatagagcatgcacttgaagtaagagagcagcttaaaacaatgcttgataatgctgaaaatgacactgcgttgcaaactattcagtatgattgtgatagacttgataatgctttacatgaatatttaggtgataagtttgatgatgttacacagggttacgctagttctcgtgatccaatgggtcatcctcaagatttaattactgaagatttatctaaaattagtgcttcctcagattttcgagatctgaatgctatagatttaggtacacaggtgcaggtaggtagtgatataggttcagatgtattacaacagggttcggcagatggtaatcgaagtgaagttgaagtatcaatggatatatcgaaacgtgatgcgttgttggagcaaatggaattaaaaggtatggaagcagcatcaggtactgaggcacagctatatgatagtgctgagttaagtactcctttagatgttacatcttctattaataatgtgtcttcagaagtatcacaacaagatttagcgagtaatggtgaaattgaagtatctctagataaagatctggaattgaagaatttagatgtggtatcaggtgatattccagatgttgaagttacctcaagttcagatgatgtgacacaaatatatgatagtgctcaagatagagattcttgtttagatattatatcttctgcggatgatgcaagttcagaagtatcacaacaagatttagcgagtaatggtgaaattgaagtatctctagataaagatctggaattgaagaatttagatgtggtatcaggtgatattccagatgttgaagttacctcaagttcagatgatgtgacacaagtatatgatagtaccgaagatagagattcttgtttggatattgtatcttctgcagatgatacaagttcagaaatatcacaacaagatttagaaggtaatgatggatatgaaattgataaggatatgggatcctcaaacgaatcaatgctagatgaaattccaggaggatttgctgatgttatacaagattgtagtgatgctagtttaagtactcctttaggtatgtctgcaagagatgatactgatgctacagatactgtagaggatccaaaagaaaatgtgttaccgcaagatgtagatttagaagatttggacacaactcattctacgaatgatattgcagattttagtggtgaaagttcattatttgatgctacttcggagtcagatagtgctgcatttgtaggtgagcaaagcattgatttcagtaccgaggaagggagtgatttaccttcggaagttgtagcgcagcatgatgtagattcacaagattcatcagtatcagtaagtgatatggctgttgcggatatggaacaaggaacagaggattctaaatacaccgatgttgatggtttgagtgatagtgttttagatttaggttatttagaaggtaatgtagataatcctgatattgagcctgaacatgatatgtcacagcaatatagtacagagactgaagaactcagtgatatgctatctgatgatgtgatagaaccagaaggagtaagtgaaactgatactcaggttgatagtgaagaatctcaagatgacagtggtactgcaggtcaagttgaggatgaaagagtacatgatgaagtaccttatgatactcaagatagtacatcaggagataaaggtgatattgcagaacatgatgataaagatggtgttgtagaacatgaggatactgtagatcaaagtattgacgatactcatgaagaagaaggtaagtttactgaaggaattgtatctgaaagtgtgacagaaccagaaggagtaagtgaaactgatactcaggttgatagtgaagaatctcaaggtgatagtagtgcttcggatcaagttgaagatgaaagagtacatgatgaagtaccttatgatactcaagatagtacatcaggagataaaggtgatattgtagagcatgaagataaagatagtgttgtagaacatgagggtactgtagatcaaagtattgatgatactcatgaagaagaaggtaagtttactgaaggaattgtatctgaaagtgtgacagaaccagaaggagtaagtgaaactgatactcaggttgatagtgaagaatctcaaggtgatagtagtgcttcaggtcaagttgaagatgaaagagtacatgatgaagtaccttatgatactcaagatagtacatcaggagataaagatgatattgtagagcatgaggatactgtagatcaaagtattgacgatactcatgaagaagaaggtaagtttactgaaggaattgtatctgaaagtgtggcagaaccagaaggagtaagtgaaactgatactcaggttgatagtgaagaatctcaaggtgatagtagtgcttcaggtcaagttgaagatgaaagagtacatgatgaagtaccttatgatagtcaagatgatactcaagatagtacatcagaagatgaaggtgatgtcgtagaacatggtgataaaggtgatattgtagcgcatgaagataaagatagtgttgtagaacatgagggtactgtagatcaaagtattgacgatactcatgaagaagaaggtaagtttactgaaggaattgtatctgaaagtgtgacagaaccagaagaagtaagtgaagctgatactcaggttgatagtgaagaatctcaaggtgatagtagtgcttcggatcaagttgaggatgaaagagtacatgatgaagtaccttatgatattcaagatagtacatcaggagataaaggtgatattgcagaacatggtgataaagatgatattgtagagcatgaggatactgtagatcaaagtattgacgatactcatgaagaagaaggtaagtttactgaaggaattgtatctgaaagtgtgacagaaccagaagaagtaagtgaagctgatactcaggttgatagtgaagaatctcaaggtgatagtagtgcttcggatcaagttgaagatgacaaggtacatgatgaagtaccttatgatagtcaagatgacgtagaacatggtgataaaggtgatattgtagcgcatgaagataaagatagtgttgtagaacatgagggtactgtagatcaaagtattgacgatactcatgaagaagaaggtaagtttactgaaggaattgtatctgaaagtgtggcagaaccagaaggagtaagtgacgttgatactcaggttgatagtgaagaatctcaaggtgatagtagtgcttcggatcaagttgaagatgacaaggtacatgatgaagtaccttatgatagtcaagatgatactcaagatagtacatcagaagatgaaggtgatgtcgtagaacatggtgataaaggtgatattgtagaacatgagggtactgtagatcaaagtattgacgatactcatgaagaagaaggtaagtttactgaaggaattgtatctgaaagtgtggcagaaccagaagaagtaagtgaagctgatactcaggttgatagtgaagaatctcaaggtgatagtagtgcttcggatcaagttgaggatgaaagagtacatgatgaagtaccttatgatgctcaagatagtacatcaggagataaaggtgatattgcagaacatggtgataaagatgatattgtagagcatgatgataaaggtggtgttgtagaacatgaggatactgtagatcaaagtattgacgatactcatgaagaagaaggtaagtttactgaaggaattgtatctgaaagtgtgacagaaccagaaggagtaagtgaaactgatactcaggttgatagtgaagaatctcaaggtgatagtagtgcttcggatcaagttgaagatgaaagagtacatgatgaagtaccttatgatagtcaagatgatactcaagatagtgcatcagaagatgaaggtgatgtcgtagaacatggtgataaaggtgatattgtagagcatgaagataaagatagtgttgtagaacatgagggtactgtagatcaaagtattgacgatacttatgaagaagaaggtaagtttactgaaggaattgtatctgaaagtgtgacagaaccagaagaagtaagtgaagctgacactcaggttaataatgaagaatctcaaggtgatagtagtgcttcggatcaagttgaggatgaaagagtacatgatgaagtaccttatgatgctcaagatagtacatcaggagataaaggtgatattgcagaacatggtgataaagatgatattgtagagcatgatgataaagatggtgttgtggaacatgatgataaagatggtgttgtggaacatgaggatactgtagatcaaagtattgacgatactcatgaagaagaaggtaagtttactgaaggaattgtatctgaaagtgtgacagaaccggaggaagtaagtgaagctgatactcaggttgatgaaacacttcaggatttagaacatgaagatcttaaagagggtgctgatgatatatctgatagtgaaacagatgaaaatagttcaggaaatagtgatagtgtatccgatgttgaagggttagctagtttagcatctattggtgaagaaagtacgataactcaaaatgtaaaaacacaatctgtacagtctagtgctatattatcgatgaaagatagggacggagttctagataataagggtattccaagtgatcaattggatgttaaagatacagaaaagaagaagaaagaatctagcaaaagcaaagttgagaattctgataaaaaagcaaagtcaactaaagcaactgtgactccaaagtctttaaagaaaacttttaaagtaatattgagtcaatgtacgcaagaattatcaaataaattatctgaagcttttgataagttatttatagatcctcaaagtggtaaacaaaaacgtagattatcaaaacaagatattgcattaatgatagagcagcttaaggcaatgatagaatcattaaaggatagaaaagcacaggtgacagatcctgatgaaatgaaagcgatagaagaaagtattaaacaagcagaatctacaattcagaatttattgaatcaggaataattccactatcataagagagttagtagtattttaggttgaatagagagttaagggaaatttatgtttatttattatataaacttctataaggcagtgtaaagtaacttctatatgtaaatatattaaagattatatcaattttagcataaatctaaacttttacttctatgagtgcaatattgttgcaattatattctttataattatttatagagtatggtaagtaatctgaatcaaatcttacaggcacatcaaattcgtaatctacatgtatttttactccattatgtggtggattgttgaactctatttgaccatttaagaaatttatagaaaacccatcggcttttataatgttattgtagtaaatttttactgtattcataactggttttgtaattatacgtgtgtatgagtattgatcgatactatatgttttgattatttgaaaatttttttgctgatcatttcctataccaatttgttgtttttttgctttataatctagccaatctttaaaacggaatccaatagctttacctttatgaatgtaaaaaaaatgaattaatcttactaattgatcttttgattttgtgttatacattacattgtatttgttgcgtgggtatgatagattgattctacgatattcacttccattatttgtttcaataatgtttgttgaaaattctggtccaccagttgacccgtaagaaatatcttctggaaatcttatttcatggaatgtcattgttattgttagttatgtaaaatgtattttaaaattgtaggtataaagatacttttgtactgattatttaatgataataatagtaattaaacatcatgcttattgttctagatattaggattacacttttataatgaataatatgctaggtataggtattatatatgcatgttgagatttatgtaatcaaatactaaagaaaaacttatattccagttgaaccaaatccttgggctccgcgttttgttttatcattgtcaaaatcttcaacgagatcccatgaaatacgcgttattggagctattatcatttgtgctattctatctccgtattttatagtatatgcttcatttccaagattaattaagataactttgatttctccacgatagtcagcatctatagttcctggagtattgagtacagttataccgaatttaagtgccagtccagatcttggtctaacttgagcttcatatccattaggaacagaaattgcaataccagtattaatgcacactctgcatcctggttctaatataacgtctgtgacaactgctgaatataaatccataccagaactattatctgttgaatatgatggaagaggcagattatttttggttaacttaataaccttaattgacatgtttggaatgatagaatgctccatgagtttcctataattgtgattttaatttgtattattcaataaatctattaccaagtctaccatgaatatatataatgaatagagtaatttttttaatactggaagtgcaagatagaaaatttaccattgtgaaaatagcagatatgttatagtttgtattctcttaattgttttggtatattgaatgcaacgttctctcttataacttctaaatctgataacttgatattcatgtgctgtttcagtaaatctattacttctgtgattagtatttctggggctgatgctcctgcagttattcctattttgtttacatcttttaaaatatctaagttaatttcctgataagaatctattaaaaaagcaggagtttttaattcagctagttcttttaaacgatttgaatttgaactattcttgcttcctaatacgaatatgatatctactaattctgataattgttttacagcagtttgcctattttgagtagcataacagatatcctttaaatctggccctttaatatttgggaatttttgttttagtttgttgattatttcttttgtgtcatctacacttaaagttgtttgtgtaacatatgcaagtttatctgaatttgttacttctatattatcaatgtcagataggttttgtactaatagtacagggttggttatttgtcccatagtaccttcgacttcacgatgccctttatggcctattaaaattatttgatatccttttttatcataagcttgcacttccttatgtactttatttactaatggacatgttgcatcaataatctctaagttgcatgattgtcctaggtgttctatttcttttgaaataccgtgtgcactatatattaatattgatccatcttcagcttgatctaatgtatctataaaaattacacccatttcctttaaggaattaattatatatttattgtgtacaatttcatgtagtacgtaaacttttctattgtcactatggtattttactgctagctttacgatttctattgctctagaaactcccgcacaaaatcctcttggattagcaagtatcacttcaacatttttttttaaattttgatgcacttacatacctaactttatctacctaattatatattgataataaaatattgcaatatacaagttatagtaatgcccaatagtagcaatgatattccatttggtcttatgtattaaaagttctggttttattgtaaattagtagattagagtttgaaaaatatgttgcttgttggaatttacatattgtaatatagcagttataaaagtaatattgcttttagataatgtaatttgaaatagggttttgagatttcaataatagcaagataagttaataattaaactttaccgttagtgacgttttaattgtctaaacggtaatattcttaatattaataattatcaatatattttccttgtttatcgtataactgttagatacctaatattgaatgaactgtaattctgatatgtaagttatcgttttaaagttgagggttatgttatagttaagatatagaactttaagtatgttcataaaacttactaaacctgaaagtataaaccctataaggttcatataaaaaagattttatattttaatggtatataaggaggttttagtcattttctcttattaagttaataaaatggttaaatatataacttgcgtcattaggtccaggacttccttcagggtgatattgcactgaaattataggataatcatttacttgaataccttctattgtattatcaaataaagatctatgagttacttgaacatttgtgggtaaagaatcttctttgacagtaaatccatggttttgacttgtaatttctatgttattatttattttattgtaaacagggtggttgcttcctcgatgcccaaataacattttgataatttttgctcctaaagctaatgaaatgagttgatgtcctaaacatatgcctaatattggtattttagattcaataatagtttttatttgttttatgatgttttcagggattgcagatgggtctcctggaccatttgacaaaactatgccttggggttttatgaataataccttttcagataaattatcttcatttcctgaaatcatgtgaattttacatcttagtttagataaagcatctagtatacttagttttattccaaaattaattactactatgttatagagcagtgtatcatcatctgttgagttatagttgtttacaaatgatatagatgaacaatggtctctataattgtattgagaagcttttttttgtaattttgctaagtttattgagttgatgttatcaaagtgatatattattccgttttgtgagccatgctgacgcaaatgacatgtcaatgctctggtatcaatttcagagattccagttagattattttctatcatccagagttctaaatttgaatatgaacttgagtgggaatcttctgatattgttttcactatgatcccgtgggttaatattttgcgatcttcgaaatctttgtaatttattccaacattgcctatgtgaggaaaagtaaatgtaattatttggcctgcaaatgatggatcagttatagtgtgctgataccctgtcattgaagtagtaaagcatacttctccaacagtggagattttctttcctattgattttccaaaaaaatgttttccatctgataatacaagaatagaattataataacttgttaattgggacattgtttacataataaatctaacaaatctcgagaattatatagcaaattctttgaaagttaactatataatttacttttatgaggtttgttgaatgtgtatttttacgtattatctatgatttataaatttgataatatgttatccataggatcaacagtaatattgtgctatactcaataactttaaataatgtctggctgtatagtatatcataagtgtagaattttttatgttgaaaatagctatagttgggttacctaatgttggaaaatctactatttttaatagattaactagtcaaaaatctgcaattgttagcaatattcctaatttgacaagagatagaagggaaggggatgctgatttatgtggattgaaatttaagattgttgatacgggtggagtggataatacaataaaattatcttcattagtactcgatcaagtaaaattatctatagaagagtctgatataatatttttcgttgttgatgcaaggattgaacatgatgataaaaatatagagtttgcaaaatatttaagaaagaaggtaaaaaaacctataatattaattgcgaataaatgtgaaagtcaaaagagatgttatagtatagattatttagggtattttgattttataggtccagtttatatttctgcagaacataatttaggtttagtggatttatatgaagcgttgttgccatttattaaagaatatgatttaaatacattagatttacataatattaagctttctattgttgggagaccaaatgctggtaaatcaacttttattaataggttgcttgctgaaaatagaatgattgtaagtcctgaacctggaacaactagagattctatagatgtagaatatacatatagaggtcagaaatttacattgattgatactgctggcatgcgtaaaaaagcaaaggtaactgaaagtatagaagtgacttctgttcacaagactattgagtcaattaataggtctgatattgtgattttgatgatagattctgtttatggtatagagcaacaagatttatctattgctgaacttgctatacaaaaaggtaaagctattattattgctttaaacaaatgggatatgattgctaaaaaagatagatctgagttgctaaaagatatttgtaattataataaattgaattttaaagttccggttattgaagtttctgcacttaaaaatattaattgtaataaaataatagaaacaagcatagagctatataaatgtctgacaatgcgtattagtacttctgtgctgaataaatggttaaaattagctgtagaataccataaacctccattgtgtaatggcaaggtagtgaagatcaaatacattacacaagttaaagtaatacctccaacttttattgcagttgttaatggttcttatagtattgatttaacttataggcaatatttaatgagtagtttgaggaagcatttttctattgatgggattccaataaggttaaattttaaaaagaataagaatccatatgatgatagttattctaaatcttaaagcaatttcttaattgaatgtgttaagattagtatcaatgactttgaattttattataattttatatgtattcaatcaatgaaatacctgtcatttcctttggtttttctatattgagtatttctaagatcgttggggctacatcgcataatcttccattttttaatctaatttgtttactataattacaaattatgaatggtacaggatttaatgtatgtgctgtatatggcatattgttttttacatcaaacatttcttctgcatttccatgatcagcagtaatcactaatacataattagtaccttgtatacagtttaatattttatttaagcattgatctagagcagttatagcttgttttgttgcttctatatttccggtgtgtccaaccatatcagcatttgcataatttaaaatgattaaagaatatttttgtaattttattctttcaataactgtattagtaacttcttttgcagacatttctggcattaaattgtatgtagttacagaaggtgatggtattataattctatcttcattttcaaacgtgtcttctctaccaccattaaaaaagaaagtaacgtgtgcgtatttttctgtttctgcgattcttagttgatgtaatttgtgatttgctatgacctctcctaatgtatttgtgatgttgttgtttggaaataggcatgggatattaatgctttctgaatatttaaccatacctattgtgttttctaatgtaatatgattgtcggtttttatatctcctataatcatttttataatttgtattgctctatcacttctaaagtttgtcatgatgaacccatcttgtggattcatcccattataatcaccaatcacgcacggtaatataaattcgtctgtaataccagcattgtagctatcctggatagctaatgatggatctgtataacgtttagcatctgcaaatgccatggctttatatgctgttcttgtacgatctagtttgttatcacgatccatagaataatatcgaccacttattgttgcaatgtttacattatttaaatgtttgatatgttcacgtaagatattaatgtatttaattgctgatattggaggagtatcacgtccatctaaaaatatgtgaactgctatttgtatctgaaaattagataatgtatcaatgatatctaacatatgtgtatgaagagagtgcacacctccatcagatagcagaccagctatatggcatatcccattgttttgctttattttttttatgaattctaataaataacggttgttttttatatattttatttcattatttattttgcatagatcttgtaaaacaatcctgccgcttcctaagttaacatgtccaacttctgaattacctatttgtccatctggaagtcctacatttaatccatgagtaattaattggctttttggatattgtagaattgtattatcccagcagggtttgtaagattgagcaatagcattgaattgactattttcgctattaccccatccatctaatatgcataaaattacagaatggttagtcatatgttcaatgaaaaatttcactattatatgttatatcatagttgctaagatatagtagatatatttttagagtgaatgggaatatagtaattatattaatctatttttatattatgatattcctttaagaattttagtttaatctttgaaaatctgtaatatttaaattaatatgtgatttatagtgcgatatggtggattttgtaataatggtatgttttgacgtaataaatagtgtattgagtatagtgtagaaatactcgaataataattttgatgagtaaaatacattatttaaaagtgaagtatagattttgttatgctgggatattctataaaaatttaagtactgaaagcagagtattgaatacattgataggagtagaacaatagctttacaacttaagattttaaattgcaacataggttttgctacgattatatgttgtgtaaaacatttgagatatcagaagaatatggagattgaatacattgttaaagtgttaatgcatacttgaaattaacgattgtatgattgagaattttgcaaagttatcatttatataacaatatagttaaagaatgaatgttaattatctgatatactagttttatttattatattaggtttaaagtttttaatagtaaaagtgtaataagtagtattattgtatgcttgtgtttagatatataaaattaatttcagtgaaaaatgtagaatattttttaaaaggtttgacaattttgaaaagtgttcatcccgtaataatgtaaaagtagttgatttctttttgtaagtaatatagttagtttagtaatgtaataatttttgatatataaatgataagatccagtattgtactcttaattgttttggttttctttaaccctatgttgttattggcaagtgaggtaatagaagaacatgatctatataaagctagtgataattatgatgttgagcatattaaagatcatgatgttcaatatgatagtttgataagcaaggataagatttctttgaaaatgcataaaaatgctattcctgtgtttgttggtaataagattgtgtttttagctaaagatggtgtcttgcgttctgtagatagtgggaatgttaaaaaatgctattgggaattaggaattacaaaacatactaatttgtatagggcaagtatattatactctgaaaatatgatattttatatagcagatgataatgtctattgtattgattttgaaactggagaaataaaatggcagaaagaattaaggagtgtgattgctggatctcctgttattattggaaatcatttaatggttgttactgtagataattgtttatacttttttaatgtgtctgatggatcactaatatcaagtaatcaggaatcacttcctgaagtaaaaagctatagttcgttgtcttcagcatcatatggtgaaacagttatattctctttttctaatggaaaaattgctgcatttaattctttaagtggtttaaaaatttgggaaagcgatgcatcaaatactaatgttgcatttgctcatggaatttctttagaggcaacaaatggtactgtaattgctgttgataaattacatagtatatcgaatattgatattgagtctggtaaaaccagatggtcaaaaaatttaaaagttaaaggtatttctaaaattgaaagaggtaatatagcaactgtgatagacaataaacttgtgttaatggatatcagtacaggagattttttatggcaatatgacttgttgcaacatggaaaacctaaaaatcaatggaatgctcctattataatgaatgatgaagttttagtcataggagatgatggctgtgtggtattaatagattataaatctggagctttaaaattaataaatcatatattaccatcaacttattatgttccagtgtttgtaaattcttcgctttatgttgtaacaaataagggtaaggtagttatttttcattgaatgatactataaggtataaatatgcaaaattatgatatggtagttattggtggtggtcctgggggttataagtgtgcaattagaggagctcaacttggattaaaagttgcatgtatagataaaaatgaaattttaggaggtacatgcttaagagtaggatgtattccttctaaggctttattgcatttctctcatgagtattatcatttgaagaataatttatctgaagttggtataacatttgataacttaaattttgacttagaaaaaattatgtcttttaaggataaaaacattgctgagttaggaaatggtattagttatttgttttctagccataaaatagattatttatgtggtgttggtaagatacagtctgtagggcctaataattttattattgttatatctggaaataatggtaagcaggagataataagtaggtatgtagttattgctactggatctgatgttgcaaattttcctgatattgatgaagaaagagtagtatcttctactgcagctttgtcttttaaggagccaccaaaaagattaatagtcataggggctggggctataggcttagaaatgtcatctgtatggagtagatttggatctgaagttactgttgttgaattttcagataaaattgctcctagtatggatggtgatattggtaaagctttgcttacaagtttaaaaaagcaaggaattaattttaaattatcaacaaaagttagttcaattgacaaaaaaggaagtaatttagctgtgcatcttgagtctgtgaaagatggtaagtctgaaataatagaggcagataaggttcttgtatctattgggcgtgttccatatacgaatgggttgattgataataattccatagaatgtgatgctagaggatttattaaagtgaataataagtatgagacaaatatacctggtgtatttgctattggtgatgttattggtggagcaatgcttgcccataaagcagaagaagaaggtattgctgttgcagaattaatttctgggcatgttccacatgtggattatgaaattattccatccgtaatatatactcatcctgctgttgcatcgattggtaaaacagaagaaagtttaaagaaggttaattatagttataatgttggtaagtctaatttttctgcaaatggtaggtcaaaggttacagataatgtatcagggtttgtaaaagtattggcttctaaagaaaatgatgctattttaggtgttcacattattggtgcatatgctgatactatgattaatgaagctgcggttgctatggcttatagggcatcatcagaagatatattccgcatttgtcattcacatccagatgttaatgaagcatttaaagatgcatgtgaagcagcatttttaaagtgatttatgaggtttaagtattgtgttgcataagctattaagagtaaagttacaatataaaatagcatttgtaattctattattagctattgtgtggattagtagtggagtattgaaaaagtataatcagcaaaaagaagaaggtgttgttattcatgataattctcctaacattaaggtagtggagtctaatgctcaagatagggtagtatatttatctttaacaggtgaagtagaagcttttcgttatgttaatattgtaccagaagttgctggtaaagtatcagatgtattagtaaaagatggtgaatatgtaacagaaggaaatattttagtcaaaatagaaaaatatgaaaaagaagaacaattaaaacaaactaaagctctattaaagcaaagagaacttgaatataaagcttcacagtctttaaatgagcatggatataggtctgagataaatgatgcattatcttttgctgctttggaatcagctagggcagatgtgaaaaaagcacagattagtttagagagtacggagataaaggctcctttttctggatttgtagataaggtgaatgtacaagttggtgagttagtatctgctagttcaggattatcagtactacaattagttaactttgataaaataagagttgttacttatgttccagagaaatatttaagcaagctaaagttaggtgatgtttgtaaggttttaattgcaaaaaatgaggaggtagatgctcctattgtttttattagcaaaataataaatcgtagtacaaggacttatcggatagaaatggtacttgataataatgatttaaaaatttttacccaaggcgctgtttattctgtaaaagttcctatagggagttatagagctcatagaatttcaccttctgctttagatttacaagatgatggggatttgggaattaaagtgattgttgataaaagagtaaagtttatacctgttgaggttattgatagtgaagacaatggtgatgtttgggtagctaactctcctgatactattcagttaattactttaggtcatgagtatgtgaaagataatgcgtatattggtataaggtaataggaaattaggtttaatctgtcataattctgcggaattagtaaattcaagcgactttataagttagtataactttttcagtattataaaaattatgttgcaggttggtattgtgtattctacaatgtaggaagttcattgtttataaaatatagtggtaacaaaagaaggtataattgaagctgaaggtattgtaattaagctattgcgtgatgcaacttttatggtgaggcttaatgataattatgaaattatagcacatgcttcaggaaaaataagaaaaagtaaaatacgtatactaatgcatgacagggtgttagtagaaattagtacttatggtattaataaaggtgaagtcggaaaaggtagaattattagacgattgaaagttacagatgcttaagtttgataatttaatattagcttcttcttcagagcaaaggttgtctttattagaacagattggtgtaattcctggacaagtagtatctcctgatatagatgaagtggttttaaagaaggaattaccgaaagtttattcaatacgtatagctaaagaaaaaggaacaaaggtaagggtattatatcctgataaatttatattaagtgcagatactgttgtatgttgtggtaggcgagtattgcccaaggcagaaacagaagaacaagctcttgaatgtatacgattaatatcagggcgtagacatagagtgtatacaactgtttgcttatatactccttataataaattgcattgtagaaatgtgatgacaatagtcaagtttaaacatttatccatgcaggagatcaattcttatataatgtctggacaatggaaaggaaaatcaggagcatgcagtatacagacaagtgctggtaagtttgtattatcaattaatggatcgtactcttctgttatagggttaccattgtatgaaacttattctattttgagtcaatattttagtatatagattcttagttatagttattgatgtagtagatccaaactgtagttataagttgctattaatggtgtgactattttgtattgtacgctaattatagtgctgtaattgatgataataaatttcttgctaagaatagtagcaattgctaacatggtaagcatttaaagaataatttgttgataggtattttaaaatatattgattatatactgtctgttgagttgttcattaaaattgtatttcacacatgatataacataatggtcctgttgtatttagcaggttgttatcatggaggggtaactattatgaaattaggagaatgaaatggttaatttgccaaaatttacaatgcgagatttagtagaatctggtgttcactttggtcataaagcaagtagatggaatcctaaaatggctccatatatatatggagtgcataacgatattcatattattaatttgcaaaatactgtagttttacttaagaatgcattgaaagctctgtatgatatagttcttaagagaggtagagtattatttataggtactaaagttcaggcttctgctattattgctgatgaagcagtacgttgtggacaatattatataaataatagatggttgggaggtatgttaacgaattgggaaactatctctttatcaataaaaaaattaaaggaatatgaaaaattaatagaaaatgttgataatcaatttacaaagaaggaattattactttttgagaaaaaaagagcaaagcttgataggtctataggtggtatttgtaatatgggtggattaccgcatgctttgtttgtaattgatacaaataaggagcatattgcaattaaggaagctaataagttaaatattcctgttatagccgtattggatactaattctgatcctgctggtatagattatccaattcctggaaatgatgatgcagtacgttcaattgatttcttctgtaaaattgtatcagatactatattagaggcaatacgttctgatttagctaaatctggaattaatgttgatggtattaaggatttttcagtagaaaaaagagaagatcttttgagagcaaataatcgagatcataaaaacaataaaaataatagtactattgataatgctgaaaatcttaaggaagaaaatctggtaggaggaagtaataatgaaagttgatattaatgcagtaaaagaattgcgtaatttgacaggtgctggtgttggtgattgtaaggaagcattaaattcttgtggtggtgacatagaaaaagcaaaaaattatcttagggagcaaggtattgcaaaagcttacaaaaaatctactaaggatgtatcagatggtttagtagcagttcatgttaatggaaaccaaggcgcaattttagaagtgaattcggaaactgattttgttgctcgtaatgaaaaatttcaaaaattggtgttaaatcttgtttctttagctaatcagtatgctgttgaagatatagaagattttttaaaacatgaatatgttagtggaactagtattcatgatgaaattatgactaatattgcagtaataggagaaaatattcatcttaataaaatagggtacttatctgttaatgctggtgttgtaggtgggtatatacatagtcctgtggttaataatcttggtaaaataggagcaatagttgctttagagtctactgctgataatgacaaattaaatgtacttgcaagacaaatagctatgcatattgttgctgcaagaccagaagcattatctgtggatcttttagataaagatattttggataaggaacgtgaaattataaagaagcaggtcgaccaattaaataaaccagtgtcagtagcagaaagaataatagatggtagaatagctaaattttaccaagatgttgttttattagagcagatctttgtgatggataatcaattaacaatttctgaattaataaagaaaaaagaatcagaattgggtgcaagtattaatcttgtagggtataagctatttgtcattagtaaataatgctataaaggttagtatttttatagtttaaatttgtaggacatggtaggtatactatcttagttgtttatggcttgtatacaatttttatgtagttagtgtattttattatagtagctgtataataatttttatacagttactatgtataatgctttttattaggttaactgtattttgctttgtattaagaattaacattgtgtatgtatttcattatatagttgacaatctgtattctgtagcatgaattatacacgtacttttatatattgcagaatatatattaaaattgataagatatttatgtgttttttgtaaagcattaatttataagataaagaatattgttaaatgagagattatggatattacgcctattatttgtgctaataaaaatgtaattactggctatggtacaggtgagttttttataaatgataatgtctatttggggtctcacatagtttttccaaataaaattatttcttgtttagatcttaatatttttaacttagaaaatataattgaattattggatgaaactttagatatagtattaattggcactggtaaaaatcatatatttttgcctaatgaagtgaaaaacaattttttaaaacgtggttttaatattgaatatatgtctacaggagcagtttgccggacatataatgttctattatatgaagatagaaatgtttgtgcagcgttaatatcattataagttcttatgttttttgaaattattaatgaatatttttttgttaatggaataattgctatattaattgtgagcttagtgacaggatcactagggtcatttatgatatggaagaatctttcatatttgggggatagtatttctcatgcatctatcttgggtgtagctttagctgtattgttggatattagtatatctagtggaattttatgtatttctattatttttgcgttgttgttgtcttatagcattaataaaatctattctatagatacggttttaaatattgttactaacgttattatgtcttcaggaatgatattgttatctttcttcccatctgcaagtaataatattatacattcgttatttggggatgtactaatgttaactaatagagatcttataataatggctttagtagcattggtaattattactcttgtaatatatagatggaaatattggttaattatatctgtaagtaatgatttgtctgcatctgaaggtgtgaatgtaggttttataaaattagaatttctagtgatattatctgtatttattgcttttgcagctcaattggtagggatattattaattactgcttttttagttattcctgcagcagcagcaaggttgatgtcaaaaacaccactacaaatgatagtaatttctacaatcatttctatattttctggtataacaggacttctattatctgaaaaattcgatatttttcctggtcctttgattattatggtgtcattcctatttttattagtgatgtactgtattaatagattaatagattaatatttatatttaattttagtactagggtagttttttttaaaaattatgctagaattagtataatattataaataatgtaagtaatactatgtcatcttttaaaaatttaattatccgtactactggttttgttataggttctctattattgatatttagcattaatatgttaatgcgacgttgtagtaaaaggagtaataatgtttctatagctgtgattttattgtttagtattggaattactgttttttttcaaatatatggtaggaatgaacattcattaacatttgttaatattaaaatgtatgtgatgctattggctagtagtttaataatgttttgtattgctaatttagtgttgagaaaagaaagtgaatgttattccaaatttagagagcaaaataagaaaatttattttttgaaaattgatatagctaatttagaaatacaacttaatattatgaaaagggaaatagaatggttttttgataatttatgttctgatactaaaatttgcgttgatataaaacaagagtacttattgccagctaataagaaattttatgatattggttttttatgcaaaacagcaaaatttgttacctttagtatagcattagtagtatttttgtgtgagtctttttatagtgttcttagtcagaaatttgatttggttggattatttatgtattatgtgttaatatcattatttctgtttacatttataatagatcggttagctctttatagtgaaaagaactataaatctatcagtcagaatagtaagagtattattgatactttaaatactgaattaaatgtgaaaaagagaatgtatactgttttattacaagaagtctcaaaatataacatacttactgagaaagaattagtaaatgaaaacaatattcgtacattagaaaagtataaaaataaaatatttgatattttagatagagtttaatacacattactcaatttaattgtaaagtgaaaaaatgtattttataataggtgatctcatataatttttttatactgcatagtttaattttataaaatttttgattgaagatatataaatgtttgcataattaacattttagtttactatttcactctgaacatgtaacttacgtaaattatatagtatacgttaaataatgagagaaattatatatgtaagaattaagagtctatagggtttgtttatattgatactttactttttatcataatattatataaatctgtttatgtaagcagtgtatgaattgaaatagctatataaagtaccttacatagttttgtttgatagtatcaaagttaaaaagtagtataatgttactgtataaaatgggtagtaaattaataaaatgtacttgtataacctgatattgcttttataatgtagcctagtgttatgcattttagtattatctatgttgtaatgttgaagggtaattatgaataatgatgaggataaatactctgtatttaagacaaaagttaaaagacgagattttttaggcttgactactttatctatggcaggtattgggttgttttcatcagtatatcccttgataaaatttttaagtccatctgcagaagttatagcacagtctactgttgaagtaaatttatcagatattaaagaagggaaaactaaagttataaagtggcaaggtaagcctgtctttatacgtaaacgtactacacaagagatagaagaagccagagctgtaaaaatagatagtttgcgggatccacagtctgatcaagagcgtactcatcaaggaagggaagaatggttaataatggtaggtatttgtacacatttaggatgtgttccagttgaagtagatgatggaaagaaaggttggtattgtccttgtcatggttctaaatatgatacgtctggaagaattattagtgggcctgcaccacttaatcttcctgttcctgattactatttttctcaaaaagacgttattgttataggagtgaagggaactgatgttgcataaatataaggtaagaggtattagttaatgtctgaacatgacaatataaaaaaaacggaagggcgtggcattagggcttggatagaatatagaatgccgattggtgcttttttaaaagagttagcttcatatcaggtacctaagaacctgaattatgcttggaattttggttctcttgctggtattgcactaatgctacagattatcacagggatatttttagcaatgcattacacaccacatgttgcacatgcatttagtagtgtagagaggataatgcgtgatgttaattatggttggttaataagatatactcatgctgtaggtgcttcattcttttttatagttgtgtatatacatatattacgtggtttatattatggttcttataaaagtcctagagaattagtttggtttgttggtatttttatcttttttgcaatgatggctacagcatttatgggatatgtattaccatgggggcaaatgagtttttggggtgcaactgtaattactaacttgttttctgttatacctttaattggtcaggatgtagtacaatggctatggggtggtttttctgttgataatcctacgttgaatagattttttgcgttacattatttgttaccttttattattgtgatgcttgcttcattacatgttatagcattgcacaggtttggatcaggtaatccgagtggaatagaagtaaaatctagtaaagacactattccaatttatccttactttattgttaaagattgtataacatttggtatattttttattcttttatttttgtttgtattttatattccaaattacttagggcatccagataattatattgaagctgatcctatggtgacacctgctcatatagttcctgaatggtactttttgcctttttatgctatgttgcgttctattcctaataaattattaggggtagttactatgattggctctatagcagtgtggtttttgttacctgtattagataaatgtaaggtcaagagtggtagtcatcgtccgatttttagaatcttttatctgttctttgtagtgaatttttgttttttagcttggcttggtggacaagaagtaagagaaccatttgtaacacttagtagattatctacattatattatttctcatatttttttattgtgttgcctatattgtctaagtatgaaaagccagttgtgcttccaaaaacgataagtgatgcagtgccggagatgaaataatgatattaatgcggtttcttcttatagtttattttgtttgtgtgtcatttgtatgtgctgcagaagaatttaaacatctatctcctaagaaaattaattggaaattcgatggtatattaggttcatttgataaacagtctatacagcgtggttatcaggtgtatagagaagtatgttcatcttgtcattctatgaaaagaatagcatttcgtaatttacgtgatgtaggattttctgaagaagaagtaaaagctattgcagcatcatatcaggttttagatggaccaaatgatattggtgaaatgtttgaacgtccaggaattaaatcagattactttattcctccttttcctaataaagaagctgctatggctgctaataaaggtgcatttccacctgatttgtctttgataattaaagcgagacataatggtgctaattatttatattctttattaactggctatgaaagtcatgatcctgatgaaagtggattatatactaatccttattttactactggaaaaatgtctatggctcctccactgtctgatggtttggtacaatacacagatggtacagattctaaagtggagaatatggcttatgatgtagttaattttttacagtgggcagctgagcctgagatggaaacccgtaaaaaattaggaatcaaggttattagtttcttattagtgttgacaatttttgtaatactcgcaaataaaagattatggaaagatctttataagaaataaatgtacttttataacatttttctaatgaagtgttttttttgctaatgttctgatcttataatgattgatttagacagttacatgttaattatgtagatgataaatcttgttacttaaattaagtgcttaatttcaatgtaataaaagaccttattttcagcttgttaatgtatgatttttttatctagcaaattagggtgcatactagaataaattcctagtattataaggtatattttattaatttcttaatatttaaaatatgttatacagtatactatattatgttaaaacataataaattgtattttttaggataattagagcaattttatcattgataatactttttagtaagtatatatatcatatatcataatattattgctgttttagcaatagtgtaattagtgtagtgtgtaactaattgggtgtgtttatgaaaaatctttttgtgatttctgcttttacttctctgttaatgatgtcttcctataatgctttttctgatgaaatattagatggtatttttggaagtaataataaatttataaataatactaagaattcattttcaggaattaataataaggcgttggtaaaaggtggacgtattaaatttgctggtgatatgatatcttatacttggtattcaagtgatgatactaggaattcgaataaatttagtagggttagtaagcgttttgatatagatacgggagggaatattaataatgttggtgctaagcatgatggtatgtttagtattgaaattgattcaaatccggataaacatggaattgtatatggagcatattctcaaataaatatcccacatgtcgcaggaaaaagttttggtaataatgctgcatttaatagaggatcaaaaatatttgctaaaactccttatggtaacttttcagttggatatcaggaaggtgtagagtccatgatgaaattaaatgcttttagtatagttgctggtgatgattctaatatatggacaaagcatttaaggaatattctgcatgaaaaaaaagatggtcaaagtggttattcagtatattatttcaattttaactctgggttatatagtgaaagtttatttcgtaatagtgacaatattgtttttgatgacatagactattatttaggaactggtattatttctaggagttttattaataatttgccatttaggttatcttatcaatcacagaattttatgggattaaggtttggagtaagttactctccttttgggtatgatcagagattgtttgaattacaaaaagatcgaaacagtgatactttaattttggttgggccaaggtatagacatattgttagtggaggtatttcttatacttataatattaaaaatttaaaatttagtgcttccgtgataggtgaatatggtgatgaagagcatgattataaagcgcactataatagatattataggcataatacattaaaggcagtatccattggttggaatgttggttacgataaaatagaattagcagggtcttatggaaaattgaatagtgctggaattccttatgataagtgtgttatacatggagttccttatgagtatgtatataggagtgttattcactggctgtatttgaaagacatggattactattgggatataggtattgcttataagtatgcacctttaagtctaagtgttatttactttatgagtaatagggttggtaatgaattaagtgatgtaaatgtaggcattgaatatgatattttaaaatatagcggttttaagagtagtttgtttgctaattacaattattatacttttcgccaatttagtgacacttataggattcatgtgaatggtaagggcagtatattgttagtgggtgcaaagttaagtttttaaattttcattattttagaaagatgttgttatcatgtaaaactatagtttttgtttaatacttttattagtaatcacagtgtagttatatgtaataagcagtactaagagatataatatattgttttgattagttatatattttgaaatgtctagtatgttattgaaagtatttgcagtttctttagatcatacataatgtaaatctcagggctcatagtatattttgatatttctaataatagtgtagtgattttatattctgtttttttacctattaatttattgttgttttttacgtattatggtattgccatgtagtagagattctgttctttactacttcttttacttcatatgctaagtgtgtccaatattttataattttgtttttaatggatataattattttttttaacattatttgtcattatttatgataatgcctccagtattaactaatattctagtaaaaattgtataaagtactttacttactattatttggtgattaatatctaacttacttaatactagatggttatgttatgaaatttactttagtagcatctgctttagcttctttttttgtgttatatggaaatattttattttcagcagatatgttaggtgatgttggtatttttaatcctaatgatggaaataacaaacaatctaatggtattaatggaaaaaatctttttaagacaaaggattcaggaaatggcgagtatgatcgttcatcaaaagtaggtcgtgctttagtaagtgggcaagctatatcttatatgtgggcttcatcagatgaaaagaaaagtttctatgatatatctggtagtgcagatgattggggtatgaattgtgatgctatattacgtttaggggctgaaataaaatcaaatgattctggtgttaaatatggtgcagattttcagatagctatacctcatgttcaagggaaaaattttgaaaaaaaagctgctttaaatagaggatctagaatatttgcttctactccatatggtgatttttcaatggggtatcaagaaggagtagaatctatgatgaagatagattcttctaatatagtggctggagatgaaagtagcagttggacacagcatctgagaggtgtattatctgaaaaaaagaatgctttagggtatacaatgtatccatttcttttttctgctggattatatagtgaaaacgtatttcggaataatgataatatgacatctactgtggatggtagtaaggattttattaataatttaccttttaggatatcctatcaatctcctaattttatgggattgaggtttggttttagttattctcctttaggttataaatttcagcattttggtagaacacttgatatatattctgttaaggcaaacaaagtggttaatcaacttcctacttttgaagtaaagttaccatctgctactgtcaatttaagtgaattagttaaaaagttgggaacagctaaattagatgctgaattagagttgtctaagcagcaagaactggataaaaatgctcttcatattaagtttaaggacaaagaagaaggatatctaccatgtaaaggtaaaattgagttacttggtgtgccaggagcaggagtgtcttctcatgatcctattgaatttggtattgaagtagatagtatagaagaagttaagatccctatatctcagattgagttaaaaaacttgacaattacattaccagatttagaaaagtttgacagtaacttaccagttattcaaaaaggagatactcaagtcactaaaaaaggggaaagggaatctatagtaacaaaacgttccaaaaataaatcagatcaggtgttttttggtgcaaaatatgaacatatattaagtggtagtatagcttatagctatgatttaagtaatggctttaagtttagtacttctcttgtaggtgagtatgctcatcctaggctacattttaatacacaaaattatgatatttatccggaaaactataatttacaaggtatatctattggttctctattgagttatagtaatgttagctttgctattgcttatgggtatttggggcattctggttttgcaaagcactacattctgcataaaaagacagcacgaaatggggaatctaatgctatatatacaatgtgtgaaaggtctaacacttattattgggatatagcttttgggtatcaatataaatcttctaatattagtgttacatattttaagagtaataggagtagtaatatattacaggatattagtttaggtgttgagtatcatttattaaaagagcaaagtaaaatgaagtgcaaattatttggaaattatcaccactataaattttcggaaattactattgctgtagataatgttcgttatgacgatggttatgataatagtgcaaaaccaggtatttctcctgtcataggtacaggacttgataaaagtaatgttatcagaaatgcaagtaatggatcaggtaacatatttttagtaggtgctaaattagagttttaaatatttgtattattactattgattatttgctgagaaaggttatgttgtatgtttgaatttctgtaatgtgttttttgagtatagcgtgtgtatgtttgggtagtgctatacttttatattttaataccttatgtgtttatgtcttttatagctacataataacgttactgtattgatagtgttcatctaagaatatagtttagttcttttgataaagctaggtttattatcttttatttaaatttttttctgatatcctttcaattttattatattgcttgtattgttattttaattattttttagatttgtcttgatttttagtaaaaaaattatatacatcattatatttttatattatttattaacaatataaagattatttcttgacattgtatattatacttgattaagtattgttaatatatttatttattaaattaatttcggtaatctttatgaaaaagttttcgtttgctactgcttttgtttctttcttgcttttgtataatgttgatgctttttcagtagataatatagataaaaatcatgaaaatcagaaaaaactagtaaaccttataaaaaataatgaatatgtaaaacaagcaagtttgcatccatcaattaagagttatcatagaattgatcttgggggaaaagtattgtcttatgcttggtttactaataattcagaaaaaatgcaagatcatggagtaaaattagatggtgttttaaatataaaatctataaataataattctgatcttggaattttctatggtggtaattttcaattggctatacctgctatgaaaagtgagaattttattccttcgatgaaagcatataatagaggagcacaattatttgttgaatctggttatgggaatttatcatttggatatcaagaaggtgttgagtctataatgaaaatagatgcttctagtataggagctggagataatagtattgcttggttacaatacacaaacttatcaaaccttgatggaaaagtacagtatcaagtatttcctggattatatagtgaaagtgtgtttaacaggagtaataataatgttatttctattaaagataaggattttgttaataatttgccattcaggatatcttatcaatctccgaattttatgggtgtaaaatttggtattagttattctccaacaggttatgatagtaacttattcgaaagtgtgagttcttataatattaaaaaattaacactacctcctgtaataagtgcagatacaacttctgagatacaagcaaatcctaatgataaagataatattttatataatgcattaggtaaagaaaaagttcaagatgtcactatagaaggtatagttccgtctaaaatagagtttttgcaagcacgttatgaaaatattgtaagtgctggattatcgtataatcattcttttaatgatattgattttcaagcatctgttgttggagaatatggatctactgatattgataagttaaagtcatactcaaagtatccatctgctgaaaatttagcagcttttgctattggtacatctgttacttatcgtgatgttatagttgcaggttcttatggatatttgggaaaatcaggttatattaatacgatttattctgctactgaagctcctttaaaaatgttttctcctgataatcagtatacttattattggaacattggtgcaaaatatgtgtacagtaacgcttcaattagtacatcttattttagaagtaataaagttaatactcacttctatgactttagtttaggtattgattataatttatctctaagtagtagtcataagggacaatacaaagtttttggaaattatcattattttaatatagataataagaattttaaagtttcacgtgatggtagtgtgctattactaggtgttaagtatgaattctaagatttaattgtatttttgtgatagaattactataacttacttgtatgtagtatgtataaattactatctgattaatacatactactatgccttttgtttaaaaatagaattagttttgtttctatttgatatgtaattttaagagattttctatttaattctttctgtatattttattagtgtaatattttttattgtatgttttttatctagtatattgtgtacgcgaaaaatattttttagtgtttaaatgttttaagatgtaaaaagattggtagaaaaatatatgtcatattataaaggagttagagaagtagtattggatactgaaacaacaggattggatccagatggaggagatagagtaatagaaataggatgtgtagagttaatagatcgtgtttttactggcaaagtatttcatgaatatattaaccctgagcgtgatataccttattatgcaacaaaaattcatggcattactattgatatgctaaaagataaacctaagttttcagaaatagccgataagttcttggaatttattgataatggcatcttagttattcataatgctggatttgatattaaatttattaagatggaacttgataggattaataaaagttataactctgactttcaagttgttgatactcttgttttagctaggaaaaagtttcctggagtttcatctactttagatgctttatgtagaagatttaatatttctctacaggatagaaagtttcatggggcattattagatgcaacgttgctaggaaaggtatatgtacaattgatggggggtttacaaagactttggagttttcttataataataacgtttcaagtgctagtaatatagataaaagatgtgaaaatctttgtatagaaccacgaatttatgaagtaagtgaggaagaaataaaaaaacataagatgttgttagaaaaaataaaaaatcctatttggaataacatattttatacaaaaaccgagtaatatactttatgctttagtttattgtgatgatataaagtatcgttttcaaaaatatactgttttgattaaaagatttttagttaaactgctaagtgtatacatagataatgtaggtattgtttgtatgaaaacaaataaggtctttattaattcatatttggtgttaagtataatgttttagtatcttttgagtattaatatattttattacataaaatgattaaatcctttatttgttggtgtaataatatttctgttattatcatatagtgtgacgcaattgcctagtgttatctctcctatcttacttatttttactttatttttacaagatatgtcttgtattaggtgagagaatttgggatttatcgtaaacactaattcataatcgtctcctccagataaaatatagtttatatattgaggtgtattgtttattatttctttggcttcatttgataaaggtattttatctaaatatattgatgcgcctacttgagatgagttgcaaatatgttcaatatcttgtattaatccatcagaaatgtctatacatgaagacgcgattttattaatgctgattcctaaattaattcttggttgaggtatatcatatttattttttagtttgtaatagtttttgttgattattttttgatacacaagtaatccaagtgcagcatctccaatattgccgctaacatagataaagtctccaatttttgctccagatctttttagtatgttaccattacttgttccaaatgcagtaatgcttactataatttcatcttgtttatgagatgttgtatcacctcctaatagttttatacagaatttttcatgttcttctcttaagctatcagtaaaatttttccaccaatcttgggatatgttattaggtagtactaatcctaagcagtagccgtaaggtatagctcccattgctgcaatatctgataagtttgatctaagagcttttttagctaatatatttggattgcactgttttaaaaaatgtacaccttctataagtatatcttttgttactaataatttattttgtgtacaatttatagtagcagcatcatctcctattaatgaatcatcatctaatttatatatgtaatttttaatatattcgaattcttgcatattattctctagctatatgtttttttaaataaatatataatttgttataacatagttgtagtattaatatttaatgttttagttttgaagagatgaaatttatattttaatttttagtaattcagtaattatttattaaaaggcaatgaaaatatgttaaaagaaaaaataaaatgtcttttgaaatgtatatattatgcaatggttgatatgatcagacatgatgggatagaacatgcaggttatttgtcatttattatattattatcaatctttccttttttagtattttttatggcattagtgtcgaacgtagctcagttattaaaccactatgatattagtattaatgataaattgattatattaatcaatgataatatccctcatgaagttatttcaggacttatgccacggattcaagaaataatttcaggacctcctcatagcttattaacattagcagttatagggacaatatggactgcttcatctgctgtagaaggaataaggactatattaaataaagcatgtagagtttctagtccaccttcttatatttttcgtagattgttaagtatttttcaatttcttgtgatcactttgacaataattattgctatggtatgtataattttacttcctgtgatttatgaaatgttaaataaggatttaggatatttaaaatatactgtgagtgaattggtattgtttatatctattactttattgtattttattgtaccaaatattaaacaaagtttaatggatgtaataccaggtgcaatattagttactttattatggacatgttcatcctttgtttttacttggtatataaaaacttttcaccaattgaatataatatatgggagtttagccagcattatagcatcattgttgtttttctatattttaagtatattttttatatatggagctgaactcaactacagattaaaaaacatgtttatttaacattgaattatttaggaaaagaatttgtgtgtacgacactatataaatataatgtcgtactagaaaaatatatgctataagatacttgatgtaagttaagtacatgtttttctggttttttcatagagaagttgcgtatagagtaatactattctatacttcttgttgtgcactaggaattccttgcatagtagattgtctaacaacagaagatggtggactattattatcttggccatctagttctgatgtatttcttaacctgtgttgatcatcatcttcagaagtattttgttgtgatgtgtttcttaacctgtgttgatcatcttcagaagtattttgttgtgatgtgcttcttaacctatgttgatcatcttcagaagtattttgttgtgatgtgtttcttgatgtttcttgtgttaaaacgaatggttgtgataatctatttgctactgctgcgcttataagtgataggctacctgctgtaaaagttagaacaaatgcaagaaaaagacccattgatgtttgaggagtaccaggtatttttatattaaatgcaaggtttaatccagaatatattgtgcaaaatgcagagaatgtcattactaaagcagaaactacggttgctacattgagaagtgcattggtagcagaatgttttttattaccgttatgtatcatggttattaaccttataaattaattatttaatttaatattaaatatatatttaatataaatcaagaaaatatattaatattttaaaaagatatataaatatactactaatattttatatatttttagttgatagcttcatatttttatatgtttttgttgagtgtaagataaagactctgcaatgtgatcatatgatatgagttcttgtaaagataagtcagctattgttctagcaactttaagaatttttgtatattgcctagcagatatgttttgtttttttaatacatgtttaagaagttgtattccagatttatctggagttaaaaattttgttataatatcttctgatactatcatatcgttaaaaaacttaccataacgatttttttgaaatttttttgcaagaataatacgttcttttattgtttttgagctttctacttttttatgattatcatatgatagcatattgatatatggtacttctatgtgtatatctattctgtcatttaatggaccagaaattttactttgatattcaatagcacacttaggagtcttagaacaagattttgatagatcaccaaaatagccacatctgcatggattcattgctgcaattaattggaaatttgctggatattttatatgagtgtttactctggatataagaatctctttattttctaatggttgtcttaaggagtctaatactgatcttgaaaattctggtagttcatctaaaaataatataccttggtgagctaatgtaatttctcctggtttgatattttttccacctcctaccatagctgctattgatagtgaactgtgaggatcacggaaaggacgtatggttgatattgatttgttagattttttgataatacttgttatgctatttatttctattatctcttcataagttaaatctggtaatattcctggtaatctttttgctaacattgattttccagtacctggaggaccaaccattaatatattatgaccgccagctgcagcaatttccaaagctctttttgctatcaattgtccttttatgtctttcatatctagatattctggattttctattgaaagtttatcatttgaaacaggtataggttcattgttattgaagtaattaattagtgatataagatgtttaggagataatattgcaatgtctttgataaatgatgcttctgctccattgttatatgggcatattataccagttttttgtttataagcacttatagcagcgggtaatattccagaaactgaagttattgagccatctaatgacagctctcctagtataatgtatggtaagtcgttgatttttggtattatcccaataatcattagtaagcctatagcaataggtaagtcataatgacttccttctttaaataaatctgcaggggataaatttacagtaattctttgtgtgggtaacgatatattgattgagtttagagcagctctaatacgttcacgagattcagcaactgccttatctggcaacccaacaatattaaaagcaggtatgccttttgcaacgtgtatttgtacatcaacatttattgtgtgtattccgtaaaagcctatactcttaattcgtgccatcataaggtgtttaattaatgtgtgaatataaggtcggcattactagtttcttaattgttcattacaactttatatatcgtatttattattgtgtttgtaaagtaatttcttaatattttaagaaattttataaatatttattgattagtataatgttgtattatgattcaattgttttaatatcttgtgaatcttttttaaatcctagtcctactaaatacatttctgatgagtcttttctacttgcttttggtttaaaatactttactgattgaaaataagttttcattgattgatagaattctttttcatattctccttgtaaaattttagtgatgaaaactccgttttcacgtgtaaatcttactacaatatcaagagatatttcgcataaattaattatatttgcatgatcaacttgtttattcccacaagcctttggtgccatatcagataatattacatcaaattttttattatgaaatttatcacttaagagttctatatcattaataatgtcacattgaataaatattacattgggaattgcatccatattttgtatatcaacagcaaatactgggttattattgttgtgtgataccctttgtgctgcaaactgagaccaccctccaggggatgatccaagatctaatacatactgtccttttttaaagatagaaaacttgctatccatttctatcaacttgaacgtagccctagatctataaccttgtttttttgctaatgaaacataggggtcatttaattgcctgtgcagccaccgtgtggaagaaattttacgccctttagcagtttttacgatagtagatatatgtttacatttgttacgttaaagtaaaatgataaattatttttgtctggtgacaagaattattttattgatataatgtatattcttgataccatatctatatctattacggagcgtggcgcagcctggtagcgcacttggtttgggaccaagtggtcgggagttcaaatctctccgctccgaccattgccatctttaaagcctatagaatgctgctgtttagtatgttgtttatatatagagcaggttgataagttgcttaatggcctataaacttaactgcaattattattgcttaatattgttaagtgtgtaatgcatgtaatgctgctttgataatattaatggaaatcgtggtcatactgacttggttgatgtgtagtgggagtagggctaggcgaacgatcatgatgatattcaggttcttgttgtagttcgtgatttacattattgagtccattgccggtagcctcagcaacctcttggttagcatgtgggtaatcatcgtgagcgtatggatcatcagggtgtgctgcttgtataccttctccatcattttccccactggcagctgctgcatcttcacctcctccttcgccagatgcatctcctgattgtgagtctggtaataattttggcaatccaaaaatgttttttgtcatttctgatccaaacactactgtagttggtaagtttgctcctaaacatgtggttgaggcaatcacatttccagttgcactgtcaagaaaacatggtacatttttgtaaaaccatgcaagaaatacaaaaacggaaaatactgtttcttcatcttctggtgctcctccactgccggtattctgttgatgcaggtaagattgcaatgcagacacatttattccgccactttcatttccttccatagactaattactaagtgaaaaatgataatctatattatattgtataattgtaaatatatttttaatatgtgtattatttgagtttgataaaaataaattattgtgtaatgtaaaataggatttactgcaagttggtagtgttttatataaaaatcagtggcattaatagaagatatttttagttggttggcgtaagaaaaagttaatctcgtagatctataagttttattatttcttctctatattttattaaaattgtgtttttttctgtcagaaagtgttttttgaaaaagtatcctaatacatttaagcttaatttaaaatctgttttagaatatttgtattcataattattatacacatcatataataattgaggtaggggtaataaacttttgctatatggtaatccaacggtttttgagactgcttttccagtttttggagaaataaatgttaagttctcatttgtattatttacagcacatcgtgatagatctaacccaaatcctaattctgataatagagttaattctaatctaaggtatttaattttccaattaatatcctgaaattgtattgaattaataaaaatatctaggcaattataaataatgtaattttcttcattctctggtaatacttgatctaatataacagtagaaaaagctatacacattgttttaagattatcttgtatatagtggtatagagtggatttaattaattcatacttaaaacaacctagattacttattagtcttgagctccatgttacattaacataatctcctatttgtaacctgtgagttgcttttttggaatactttgctaatcctttttttaaaccatgtttttgagtaaatatagaaattataatttgatcatcaccgtattttcttattgcaattactattccttgatcctgccacctcacattaaagctcgttttatagtagttgatgtactatcatacatatgtaagtaaaattggggaatatataatttattacttgtgttattatatttaactactgctggataattatgtgacttaatatactttagttaagtattaattaatgatgtccgggaattatactataattagcataaaatcatttataatttaaatttttgtttattaataatttatgatgtgaaatttaattctgtatggtcaacaagttatttagtaggtacctaatattgtgagctaataaatattatattgcttacttttaatattggtggaaagctgtataatgtagtggaagttatagtggaaattataagagattactatcgatgaatttaattaatactgttaaaaattgtatagtggaaaagttacatatattaagtgataagaaattaatagtgctggatgatgttatattaagtaagttaatagttgattatcctaataatcataatcatggggatttgtatactaatgcagctttaattttaagtagtcatataaaaaaaagtccactagagatagcagaaattttactatctgaattttctaatattaaggaaatatctagcattaatgttgtgaagccaggttttattaattttagtatttctctttatgtatggtatgaagtagtagcttctattaatatgttaaaagagggttttgctaatgttaatataggaaatggacagaaagttaatgtagaatttgtttctgcgaatcctactggaccaatgcatattggacatgctcgtggtgctatatttggtgatgtattagcgaatttattggaaaaagtaggatatcaagttgttagggaatattatattaatgatgctggtacacaaatagacgtgttagttgaatctgtatatttaagatataaagaagctacaggtcaagatattgtaataggcagtgggttgtacccaggattatatttacgagagataggaaagcttctatatgaaaaatatgggacagatttattagagatgagttttgtccgtaagatgaagattatacgtgatgtatctcttgaatatcttatgaatcttattaaagaagatcttgcattgttgggaattgagcatgatgtttttacgtcagaggctgagttattaaaaaataatattgtagaaaagtgtgtgaaacttttagaagataagcaattaatatattatggagtgttagagcaaccaaaagggacagaaatgcaaaattggaagcctagaacacaaatgttgtttaaatctactgatttcggagatgatgtagatagagctttacagaaagttgatggtagttggacttattttgcaaacgatatagcttatcattttgataagatatcacgtggttttcaacatatgattttagagttgggttctgaccatattggttatgtaaaaagattaaaagctgcagtgaaggcattaagtaataataatgctactgtagatataaaattgcacaatactgttaattttcttgatgatggagtgcaagtaaagatgtcgaaaagatctggtgaatttctaactataagagatgttatagaaaaagttggtaaagatgtagtcagatttatgatgttaactcgtaagagtgatgtagttttggattttgattttgctaaagttgttgaacaatctaaaaataatccaatattttatgtacaatatgctcatgctcgtgtttgttcattaatgcgtaatgctccaaatattttaggaatagaggatacggatttttctgtgttatcttcaaaggaagaaatactgttaattaagttacttgcaaaatggccaaatgtagttgagatgtctgcaaaaactgcagagccacatcgcataactttttatttaatagaagttgctgaagcttttcatgtgttatggggatatggaaataagaatgcaaatagacgttttattatagataatgatgttaatcttacatctgcaaggatatatttggctaaatctgttgcgtatattatcagtagtgggttaaaaatattttccatagttcctttagaggaaatgcattaacagttgtagtatatgtttttttaaagatgtgttttagataatgtaattataatagaaataatatacgtagtattagatacagtgttcttccaatagtcaatgagactgttaatcaaactgaagtgtttgatttttttaaaaacacagatacatctttatcctttattgtagttttacaatactctgtgatatttttaacatctgtaatctcttcacatgcaataagtgatatagataaagtttgttgcgctatatattgagaccatgttttaatagagtcttgtactattttatcttttgtatatatcataacatctattttatcagagatattaaatttattatcttttctagagtgttgtattactcttactatatcccttgctatgccttccattatcaaatcatcagaaagttcatgatctaataacactacaccaagtaaattttggtctaagttaatagtgcatgcaaaatcattatgcactttaagagttaatgtatattcattattatttattatataatgttctgcttcttttgtaccaagaagtaactgattattttctaatatttcccattgattattttttaataaaaatattaaacgtttaattttatcaggtatcctttttccaagttctggaaagtttaattttagttggaacgatgctatatcagatatatcagatttaaatgatatactttttacatttatttcttccaataaaatattttggtattctataggtagattgagtaattctggacaattatagctatatataactattttattaagaggttgtctgaccctaatattatgaatattcctgatagatagcacataattacatatgcttattgttaatttcataaattgagtattttgttgatctttatcacttaacatgaagttattcatatttggtagtgatgataaatgtacagattcttctttttgaaagtttaatttttgccaaattgcttcagtaataataggtaaaaatggagcagaaacttttatcatgaaatatatgacggtatataatatattatacgcatctattttgtcttgattgatttctgatgaccagaatctacttctacatcttctaatataccagttatttaatatttcaaaaaactgagtaatattgttgcatgctagttttatattatacccaaagttattagagcatttgtctagctcttccatagcattaaatatagactttatagtactgatgcactcgtatattatgtatctgtccattatgttgtttattccgttgagatctgtaataatttctgcttttattttgtctatatttgcataaatagtaaaaaaattgtagctgttccatactggttttatgacattacgtagtacatctcgtatcattgttccttctttatctagtaatagatctccaccatatagtactgtgtgtgataacattaggaatcgcatagcatcagaaccatattgcttgaacatttgcatgggatcagcatagttgttaagtcttttggataatttttgtccttgagtatctaacactacaccgtgacatatgcaatttataaatggtggcttatcaaataatgctgtggataatatgaataatgtataaaaccatcccctagtttgagcaatatattcagtaataaaatctgctgggaagtagttttcaaaaaattctttattttcaaatggataatgaagttgtgcataaggcattgagccagattcaaaccaacaatcaaatacatcattaacacgtctcatcattgattttccagttggatcatctgggttaggacgtactagattatcaatatatgggcggtgtagatcatttatagatgatatgtcaaaatcttcttctaatgctctgacattatcgaatattttttttactgatccatatacatcgattcttggataattcgggttatctgatttccatactggcaaaggagttccccaaaatctgttacgtgatattgcccaatctttagcgttttctagccacttaccaaattgtccactgcgtatataattaggaatccagtttacagtcttattaagttctatcatcttatcttttatttttgtgactttaacgtaccaagatgacattgctctatatattaatggagtatctgtgcgccaacaatgtggataattgtgtaaatattgatctgtcttaaagtaaagatttttctgttttaatatactgataatttcatcatttgtatcaaatacatgcatgtttgcaaagtctgaaatcttattagtaaattttgctccatcgtctatagggcaaatagttgatagtaaactagatgtatctccatcaatgtttggaataccttgcttttgacataatataaagtcatcttctccaaatcctggagcaatatgtactattccagttccttctccttctactacaaaatctgctgttagaactttaaatgcatttttaatatctgcgaagtattcaaatagaggtttataatgtaagttttctaaattaatagataaaatatctttattatataactgatattctattttattttttttacaatgttcttcgaaaatttttaaatatcctttagcaaaaataaacatttcttgattaataatagctccgcagtatttaatgcttgcgcttatagctagagcaagattgcaaggtaaagtccatggggtagtagtccagactagcattttatattttttgacattttctattgtaggaaacttgggattttctaataattcaaatgctacagtaacagttttgcttgttttttgtctgtatgcattgtctattctagtttcaaagtttgaaagaggtgtttgacatgcccaactgtatggtacaattttgacagattcgtatattaatcccttgttccacaattcatgaaatgaccacattattgattccataaaagatggattcatagttttataatcattttcaaaatctacccaccgtgcttgcctatctacatattgctgccattcttttgaaaatttcattacagaattgcgacaatgattattaaatttttctataccaaatttttcaattgctaactttcctgatattcccagttctttttctgataacatttcagcaggtaacccgtgacaatcccacccaaatcttctgtcaactttaaatcctgccattgttttataacgagctacagtatctttaatgaatccagttagcaaatgcccgtaatgaggtaatccatttgcaaatggtggtccatcgtaaaatataaatcttttgttttcatcacggttatctacagattttttgaaagtatcattttctttccaaaactttaatacctcttcttctattgatgggaaatcaggttctcctgttaattgtgagtaatgttctgtcataatgtttattattgagtatagatattttactatacacatatttattgaagctgcaatcagagttgtattaaaatatgtgaaaattattgactcctattaatatttatagcattgttttaaaaaatttatatggaggaatatatgacagttgaaataggggatgatgcaccacattttaagggtattgatgcttataaaggtgaaaagaatatagtattgtatttttatccaaaagatgatactcctggttgtacaagggaagcaaaagattttcaagatgcgatggatgattttgctgatttaaatactgttgtaattggtgtatctaaggatagtgaaaaatctcatgaaaatttcaagaagaaacataatatattatttgaattaatatctgatgaaagttctgagttatcaaagcaatatggtacttgggtagaaaagaatatgtttggaaaatcttatatgggtatagatcgttctacatttttaatagataaaaatggaaaaataagaaaaatgtggagaaatgtaaaagttagtggacatgttgataatgttcttgagataataagagagataatgtaaattgcaaactaatgatacaaaaggcaaaaaagctgaatgttaggttgtatgtggattgtactcttagtaaatcttctatagtaatattagataatattgcttctcactatatatgtcatgtaatgcgtgctgcgaaattagatgaggtaaagttatttaatggcagggatggagaatggataggcgaaatatttgaattatctagcaatactaaaattagagtaaatgagttaattagaaggcaatatgtacctaaaagtttaacattgtgtctttctattgtcaaaaatactgcattacagaatgtcattaggcaagcaacagaaatgggagtaacatttatacagcctatttatacacaacatatagcaacaagtaatataaatttatctaaatgcaaaaaatgggctattgaagctgctgaacaatgtggaaggcttgatataccagatatttcttttcctattgattttattgatttaaagcagttgaaaactgatgacaacaatttcgtgatttgtgatgaaacaggtaaaggtcatcctccatcagaggttttaaaaggtaagaataacgttcatattattatagggccagaaggtggtttttcaaatgatgagttaagctttgcctatagtttttgtgatgggttatctttaggtacaacaatactgagagttgatacagcagttgttagtgcattagcttatgtaaaagagtattatggtatgttgtagtagaattatggttgttgaagacattgtcaataagaaagctgagttgcgaaaaaaatatagaaagttaaggaaagaagtaaaaaataaaaaagaagcgtcttattctttattacagaattatgtcaataatgttatcatagaagaaatgtctataatttctggatatatacctatagatggtgaaattgatgtattaccgttaatggattatttaatgcagcaaaaacatatagtagcaattcctgtaatagaagaaaatagtaaaatattattgtttcatcaatggaatacaattaattctgtgattccaaatatattaatagtacctcttattgcatttgataaatgtttaaataggttgggttttggaggagggtactatgataatactatttctaaattaaaaccaaattgtaaagtgataggtgttgcgtatgatatacaattatgtgatatagtacctactgaaagccatgatcaaattttagatatggtgattacagaaaagaaagtttataaaaatatataatatctgattgcaagtaatctggagattttaatacgttgggctttaatttgtgtttttttataagttttttttcatgtttaaattattgttttaatgtacagttcattatggctattaattgagtgacagtatattgaaatgcatagtaaaacgctgtcttttgtgttaaaagtgtaatacaatgttgttgtttaaagaaattatacatgcatactccagttttattgaacgaaatgttagacatattaaatcctcaagatgggaaagtatatgttgatgcaacgtttggggcagggggatatactagagcaattttgaaatctgcaaattgtcaggtttacgctattgatcaagatgaatgtactaatgttttctatgagaaactggttaatgattttccgggcaaggtacatttttgtgttagtaaattcagtaaaataaagcaaatattgcatggagctcaattaaaaaaagttgatggtatagtatttgatataggagtttcttctatgcaattggaagatgctagtcgtggtttttctttttctaaagatggtcctcttgatatgaggatgagtacttctataagtaatgttgatgcatcggtatttgtgaatacggcatttgaagaggagatagctaatgttatatatcagtatggaggtgaaaagtattctcgtaagatagcgaaagcgattgctgaatcaagaaaaaagaaaccaattaaaactacgggtgaacttgcatctatagtaagatctgtaatctcacgtagtaaaaatcatagtattgatcctgcaacaaggacatttcaagcaattagaatatgggttaataaagaattagaagaattagaacaaggcataattgattctgctgatttattaaatccaggtggaaaaataatagtagtgtcttttcattctttggaagatcgaattgtaaaggtaatgtttaaatcattatgtagtggaagtagtgtaatttcaccaataggatttcagttaattaataaaaaagtgataaggccaagttttgaagaaatattgaataatcctaggtctaggtctgcaaagctgagagctatattaaaaatatagtgtgtactttaaatgaaagtttgagatttgttatatattaaatggatcatatatatatggttcggcattggcattttttttatgtatatattgaattaaagtagataaaatagcatatcgattatcttttatcgatgatacgaatatctctttttttgtatactgtgataataattgcttttttttagtaatttcttttttctctagtaaatcgcttttatttaatactatgaactctggtttattaattagctctttattataaagtaataattcttttctaatacattcatatgaatcaataatatcatctagagtgcagtctatgatgtgtagtaatgtagaacatctttcaatatgttttagaaatttgtcacctattccatatcctaaatgtgctccagcaattaatcctggtatatcagctaatactaattctctattgtcaataaaagctactcctaaatgtggttctaaggttgtaaaaggataatcagcaatttttgtttttgagtcagtacatgaagctaaaaaactggattttcctgcattaggcaatcctatgattcctatatctgaaataatttttaattttaatgtgatatatttttcttctcctgcttctccgagggtaaaataccgaggtgctctattagtagatgttttatagttagcattacctgttccacctttacccccttgtgctactataaccttttgattttctgaactaaggtcagcaattaatattccatcttcatcatataattgagtgcctataggaacttttataataatatcttttccagatgatccagatttctttttgccagaacctggatttccattttctgcttttatatgctgtttatatctaaaatatagtaatgtgttaatgtgattgcttgtagcaaaaacaatattgccaccattaccgccattaccgccatctggtcctccgaattcaataaatttttcacgacggaaactactacagccgtttccaccatttcctgcttttaagtagacttttgcttcatcgataaagctcataatgatccatagtatattgctgaaatgcccagtagtttttctatatataatagttcgttatattttgctaggcgttcagatctagataaagaaccagttttaatttgtccgcaatttgttgcgactgctatgtgagaaattgtagtgtcttctgtttcacctgatctgtgtgatattataacgttgtaattgtttttttgagcaagtcttatagcattaaaagtttcagttaatgtaccaatttgatttggttttattagtactgcgtttgccatgttattatcaattccattttgaattaacttacagttagttacgaatagatcatctcctactatttgtattttgttacctaactcttgtgttataagtttccacccgtttatatcttcttctgctattggatcttcaattgatatgatgggatactgtgaaattatttttttgtaatattctactaattcttgagtatttaattcataatctgcaaatttatatttttgatctttgtagaatgtagatgcagcaatatctaaccctaatgaaaaatcttcatacattttatatcctgacttttctacagcatctataatgatttcgaatacctcagtatttattcttatgtttggagcaaatcctccttcatctcctacattagtattgagtttcttatgtttaagaatttgttttaactgaaaaaatacttcagctgacattcttattgcgtcttcaaatttattagctccatttggaataatcataaattcttggaagtctaggttattatctgcatgcattccaccattaataacattgataagaggagtaggaagtacttttgctgtgattcctcctaaatattggtataaaggaatgtttaatgctaatgctgcagcttttgctattgctaatgatattgcaagtgttgaatttgctccaattcttgatttattatctgttccgtctatttcaattaatgcgttatctatcttttcttggtttaaagtgttcatacttataatttgtggagcaacttctgagttgattaaattaattgcttttgttacaccgtatccgttatagaagtttttatcattgtctcgtaattctacagcttcaaattttcctactgaagctcctgaaggtacacaagcttttgcttttatgtcatttgatagtattgtttctacttcgatagtaggataccctctactgtctaaaatttgtctagctaatattttactaattgttatattaaacacaacattaccttttgcttttatgatgttatttaaaaattctacaagatagtaatatcttttatgtgaaatgtaaatttattctcaatgttgacttaatttaaaagagtaacaatgttattgacatattatgttatattgagcagaattactaaaaataataattgatttgaacgttaagagatatattatgtttgctattgttgaaactggtgggaagcaatataaggtaaaagagcaggatgttataaagatagaaaagttaaatgcttctgtaggggaggaagttactttggataaagtgattgcgttggctgatgtgaataacaatattgtttttacacataatgcaattgttacagcatcagttcttgaacaatgtagaaatgataaaataatagtttttaagaaaaaacgtcgtaaaaattatagaagaaagaatggtcatagacaatacatgactgttttacgtgttactaaaattaacaatatggagtaaatatggctacgaaaaagtctggtggtagctccggtaatggccgggactcgagaggtagaaggttaggtgtaaaaaagtttggaagtgaaaaagtaattcctggtaatattataatacgtcaaagagggacaaaatatcaccctggtaagaatgttggtattggaaaagatcatactatcttttctaaaatctcaggttttgtacattttaggaaaggtgtgtataataagacgtttgttgatgtcttagaagctagttctgtttcttaaattatagtagcttttaggggtttgtagctcaggtggttagagcgcacgcctgataagcgtgaggtcggaagttcaactcttcccaggcccacccgtttaatcatgttcttttaatggatgtgttttttacttttaggagttatgtaatattgttagtatagtcttaatgttagcggtgtttgtataggtcgttattaattctgttagttttttggtaatttctaatattgtataaggctttatgttaaaggatagtgataaagtatttactaatcttagtggtcaatattctccgtttttgagatctgcaaaaagtaggggtatttggagtaatattttagaaatattaaacttaggtcctgaacatattattcaagaaataaaaaaatcaggattgcgtggtagaggtggagcaggattttctacaggattgaaatggagcttcatgccaaaaactagaaaagaaggacagccagcatatttaataattaatgcagatgaatcagaacctggtacatgtaaggaccgtgatatattaagatatgaccctcataggcttattgaaggaatattaatagctggttttgcaatgaatgtaactacagcttatatttatattcgtggtgagttttataatgagtatttagtattatctaaagctttagaggaagcttataaagctaagttaatagggaagaatgcatgtaattctgggtatgatttagatatttttattcatagaggtgctggagcatatatttgtggtgaggaaactgctcaacttgaatcattagaaggaagaaaaggtatgccaagattgaagcctccttttccagctgcaatagggttatatggctgtcctactactattaataatgttgaaactattgcaactgttagtgagatcatgaggagaggtagtgattggtttgcatctctcggaagagaaaataatactggtactaagattttttgtatatcaggtcatgtgaataacccatgtaatgtagaagaggaattagggattcccatgaaggagcttatagaaaaatatgcaggaggtgttcgtggaggatgggataatttattagcagtaatacctggtggttcatcagtaccaatgcttccaaagtctatttgtgacactgtaaatatggattttgattctttaagagctgtacaatcagggttaggtactgcaggactaatagttatggacaaatcaacagatctaatagcagctatagaaagattatcacatttttatatgcatgaatcttgtggacaatgtacaccatgtagagaaggtactggttggatgtggagaatcatgaagaaaatggtaaaaggtgatgctacatctgaaagcattgatttattattgaatattacacatcaagtagaagggcatactatatgtgctcttggtgatgctgcagcttggcctatacaaggattaattagacattttagaaatgttattgaagatcggataagggattataataatgataaattaacttaatctctatgtgttatggtttttatttgtatttaaaaatatatctgtttttcatgttaatgtactgttaggggattatatataagtaaatttttaacttttattaacatatcaataatttaattattttttatataatttttaactaaataggtgtaatatatactttaattttattattattaataaagatattaataattttaagtttggagttaatatgcacttaacgttattgttgcttagaaatggtatgcctgttttgttacctgaagcagcatgtaagtatgataagagtctaggcgttgcttatacaatggatcccattatgaatgagcaattagggattcctacatcagatagtccttatagttatctatataggtcaaactttacaaagtttgctgttgtaagtggtgcaaattctgagatgaatgtaatgtttatttttggtaatagtccagtattatcttgtcctgtatttatggtctttacacttccatatggcgttgttcgtgatgtaacaaagaatggtataatgttagataatacattgatcccgttacatggaaaagttagtgaagacttgttaggtctttcaacagaagagcaagtgatcaagttatttaatgagttaaaaagtaatctcaaaataaatgcaagttctgggcagtgtcgtatgcagatgtttaactatgttaatgggaatggtgagttgtttcacacatcatttcataatacagctttggatagagtaaccgtgaatcctgtagatggtagtagacgatatattatgaagatagaatagagatttagttttatagaattatttttaagattgtgatgagtaataaaaagctataattctatttattaagaataaatttttttagtagaacttattaaataatcagcattagcattatagaatatatattagccgatactgttatttaaagtaaattttcttgaattactaaaaagactgtattattgatagtgattaaggtcaatgcataaatatctactccagagcagaattctattttaaaaattataaatgaagacctactttataaagataatacagagtaaacaggatttgagagataaactacagatatagaagataatactattaatactgcaaaaaaatggaacaaaaaataaatcattatatttatattctgttaataattaacaaattcaacaaaagagtataactacatcaaacattcaagtaaactattattatagtcgaaatgcataagtcaataagtattactaataatctataattattgaattatgtaataaaatgaagatgattttttgaaaaataattaattccaataaagtaaaactatcatgtaatgtatccataaactaagatcttaaaataaaaatcttttacaatagtttagtatacttatttatcaattcagaataatacttaccttatattaattgactatcttgtttaacatatttataaaaatctactttaagtattgctttcaacgaacgcgaatatctgataaattattatttaaatcgcataacaatagaaaaaacatgagtacacaatgctttcagaatctcataataaatacattctcattggatactggatctactataatgtgatccaaatgtgtggtgctatattctctatgaaacacttctccgctcatattaaaaaaatcaaacctatatgtacaagaagaattggtcctaaaaggaatttttatccactcccgactattacgaaacaagtttattgtgtgctcttctggtgatatccctggagtagttatttctccacatgttattaatcttccgtcattcaacattaatccaagagaatatatattatgtaaagaaccatgttgagcaacaaaacctaaatataactctttaccttgtggatttttaccatacataaagaaaatgtcgtttgccaaaactgcattagatataaggcaatgttggccaaattttgctttatgtatcaaatgtacataatcaggatgaatattaggaactggagtaattatattgatattctgatcttttggaatgtactcgtctgatgacttatcataaatacattcgttctcaggtattaaagcaagaccattttgtgtcaacaatgatattagtttcatataattttttgatataaatatattaaattttagtatattaatattctactacattataattgacaaaatcaattttccatactaaaattaaagtttttactaaaaagttactactactactttctataaatacatgaagtactatgaataacctattctaatacagttattatcatcaagttgataaatcagcttcaatctcactaaacgttatttcgcaaattgtttcatatcagaagcttaatatcagtataaaatatacaaacaattatacagtatgtactgtaaccattttaaacctagtcacaatagcacatactaaaatttataaccttttttcacaataataccttaaaaaatctttttatttactgatttaataatatcaaatatacgtctgcattttggatcacattatagtagacccagtatccaatgagaatgtatttattatgagattctgaaagcattgtatactcatgttttttctattgttatgcgatttaaataataatttatcagatattcgcgttagttgaaagcaatacttaaagtagatttttataaatatgttaaacaagatagtcaattaatataaggtaagtattattctgagttgataaataagtatactaaactattgtaaaagatttttattttaagatcttagtttatggatacattacatgatagttttactttattggaattaattatttttcaaaaaatcatcttcattttattacataattcaataattatagattattagtaatacttattgacttatgcatttcggctgtaataatagtttacttcaatgtttgatgtagttatactcttttgttgaatttgttaattattaacagaatataaatataatgatttattttttgttccatttttttgcagtattaatagtattatcttctatatctgtagtttatgtctcaaatcctgtttactctgtattattcttaattttaacattttttatatctagtacattatttattttattgggtgcagaattaatagcaatgctagttataatagtatatgttggagctgtagctgtactttttttatttgtagttatgatgttagatataaattattcaagattgaaaagtggctttacgaagtatcttgctatagggttattatgtggaatgatattatttgttaatatagtgtttgttattaagcagtctgcaacaactgaattagtgacgggatctgtttcttatgtaagtaatgttattgctattggtaacttaatatatacaaagtatatgtatgtgtttcatttatctgggatactacttttgatatcaataattgggtctttagtattaactttgcgtactaaaaatggcaatgtatataggcaaagtgtaggtgctcaagttaatagatcatctactgtgaaatatgtgaatgttaaagtacgacaaggagtagattatgaaaattctaactgaagctggtattactttagatcatttccttattttaggtgcgattttatttactattggtgtgtctgggatttttattaatcgcaaaaacatcattactattcttctgtcaatagaattaatgttgttagcaatcaatatcaattttactgctttttcagtataccttgataatattttaggacaagtctttgttatgtttatattaacagttgctgctgcagaatctgcagtgggcttagctattattgtagtatatttcagaaattgtggaaatattaatgttgaaacagctaataagatgaaagagtagaaaattttttaggtgcttattgactaatcataattaattaggacaggttttatggttaaagttgaactattatgtgtttttttgcctttaatgggttctatttttgctagtatgatgaataatagattaatgtctcaattagttgcaacatccttagtagtttgtgcatcattattgtcatggtacttattttttaattttaaagatagttatgttattactttatttccgtggattgaattatataaattaaaagttagttggtcattgtatatagattcattaagtatgattatgctaataatagttaatacagtgtcagcagtagtgcatatttattcaatgggttatatgtctcatgatgtaggtgtatctagattcttatcttatgtgtctctatttacattttttatgttgattttaataacgagtgataattttgctcaactttttttaggttgggaaggtgtaggtttatgttcttatttattgattggtttttggtttgagaaagcttcagctactaaagcagcaatgaaagcttttattatgaataggataggggatttttttttcatattaggaattgtagcagtattttgggtatttggatctttagaatttaataagatatttaacatgcttgattcaatatatgttgaaggtgtagttaatttttttggttatccgataccttatttggatatgatatgtttattgctttttattggatgtatgggtaaatctgcacaaattggtttgcatacatggttacctgatgcaatggaaggtccaactcctgcttcagcgttgattcatgctgcaactatggtaacagcaggggtatttcttgttgccagatgttctccattatttgaattatcagttatggcgcgcaacgttattttgattgttggtgcgtttacctgtttatttgctgcaactgttgctattgtacagagtgatgtaaaaaagataatagcatattctacttgtagtcagttaggatatatgtttattgcatgtggattatcagcatatagtgtagccatatttcatttaatgactcacgctttttttaaagctttattatttttgtgtgcaggtaatataattcatgctacacatgaacaagatatccataaggtgaatgcttcttggcgtcaaataccatttacatatgtgttaacttggatagggtctttagcattggcaggtatttttccatttgctggtttctattcaaaggatcttattattgaaagtagctatcatgttagtaagattgcctttataatatgtaatttggttgcctttttaacagctttttattcttggagattgattatattagttttccataaagtaagatcaacaagtctttcaatacatgagtcaggaaaagtaatgcttgtacctttattgatattagctataggttctatattttctggtatgtggggacaaaatttattactgattaatgatgttgcattttggaaaggtagtataaagatacatgagcatgtagaagtgggattatttgtaaaattattaccattatttttaagtatacttggaatagtgtgtgcttatttaaaatatttttacaattgttttggtaatttttattgtaatcgattattcaaatttctatataataagtggtattttgatgagttatataatcttatctttataatacctgttagatatatagcgagtttcttttctaaagtagttgataaaaaaattattgattattttgggttaggtggtattactaagatagtaaattgttgctcaaagggtagtgttaagatacaaactggttttatttttgattatgcatttattatgctattgggtttgataagtattatcatgtggttaatttataataatataagattttaaagcatatgctatttttgatggttttattaccaatattggggtcatgtttattagcagttagtaattttaaggcaagttcgttatctataagagtaatttctttattatgtgctggaacttcattttttataaatattattgtagctgtaaagtttgattatttatataaaggttttcagtttatacataatctggcaccaggttttgtagtcggtatagatggattatctttgccacttctattattaacaacttttttatttttattatctgttgtttttgctttatataacatgcaatcaaataatttgcgcatatttcttgctttactgctgttattagaaggattgaccgtaggagtgtttgtttcacttgatatagtaatgttctatatattttttgaatctgttttaattccaatgtttttcattataggaatgtggggacatgaggataggatatatgctacgtttaagttgtttttatatactttaagtggttctttattatttttaatagcaatattatatatatatttcttttctggtaaaataagcgatataggacagttgacttatattttatcaaattatttgaaccttaaagcacagaagtgggtatggattgcattttttatttcgtttgcgataaagatacctgttataccttttcacacttggttacctgatgctcatgttcaagcgcctacagtaggatctgttttattggctggtattcttattaaagttggtacatatgcattactacggttttctctacctatgctaccagaagctagtatgtatttttcaaattttgtaatgatattaagcatcataggtgtaatttatgcttcattaatatcttttgttcaaactaatattaagaaattaatagcatattcttcaatagctcatatgggttttgtgacagcagggatattttcttttaatgaatatggaatatcaggagctgtatttcaaatgattagccatgggttagtgtccgcagcattatttatttgtgttggtatactttataatcgtactcatactttagagatagtaagatatagtggattagcaaaaacaatgcctaaattttccattatgtttatatttttttcgatggcttcgattgctttacctgggacttcaggttttataggagaatttttatctatattaggaatttttcattattctaaattattttcaatctttattactattggagttatattaggtgctttatacatgctgtttttatgtaaaagaataatctggagtgtacaaaattgtgatttaattaattgtaatcttaataaaaatgagttatttattttagtgattttagctgcttttatattattatttggattatatccttattatatcttattaaaatgcttaactccattcatagagcagttgtctttaagaaactttgtactttagtagcatttgagattatttattatgtattggaataattttgtttatataataccagaaatttttttagttagttcatctttaatcttcttattattggggattgtgctgaataaaaaagttatacatgttttttcattggttagtttattagttactattggtattgtcataattaatttagatgttgaaccaaagctaatttttgatggacttttaaaatctagtttgtatatttctattgcaaaaattatcattttattttctagcagtagtgttctattcatgatgttagcatctggtagggaatattgttatgaattttcaataatgattttgcttgcggtttttggtttaattactttgatttctgcaaacaatttactttctttttatttgtcatttgaaattcaaagcgtgactttgtatgcattaacatgttttgataaaaatgcaattagatcttctgaatcaggtataaaatattttgttttaagtgcgctctcttcttgtataatgttatatggtatttctatgttgtatggttatacaacacaagttgatttttatgaattatacaatttcttttcttatagtgaatatatacctttaggtgctgttttaggtgtagtactggttttgattagtatgttctttaaattatcagcagccccatttcatatgtgggttcctgatgtttatcaaggtacttcaactgttatgacagcatttttttctatagttccaaaaagtacgtttgtatttttattaattagaatattaaatgaagtattgcctagtttatctaaagactggcaacatatagtgatttgtgtatcaatattatctatatttgtttcagcatttggagcaatgagacaaaataatttaaaaaggttattttcatatgctgctgttgggcatatggggtatatgttaatttcattagcaatgaatactgttgctagtaatatagctacaataatgtatctattgttatatattgttatgaatataggacttttttctattttaatacaatatcgtgatgatgattgtaacctattaaatttgaaaggcttacataataggtctccggtaatagcattttgtatagctgtgattatgctatctatggctggaataccacctctagctggattttatgctaagtatgatgtgttgttaagtttggtagaaaatggttttataaaggttgcaatagcttttgttattgtaagtgttatttcatgctattattatctacgaattattaaggtaatgtattttgattttagtgatacttccaataatatatcattagcagacaggaatttgtctttcattctgttgtttacagtgttaataaattgtatattttttgtatttgttggtgatgttaggcgtttaataggttatttttttacattttaatttttttaatggataataatctgaatattcgatatataatgtaataaatttattgaatattaaagcatgtgaaaacagtttcaatatttggctcgactggtgctattggtcaaatgattattgatataatatttgctgaccttgataagtatcaggtaaaagtattagttgcaaaatcaaatgttcagttattagcatttcaggctaagttaattaatgcagaaagggttgttattgctaatgttgatttatatcaggagttaaaagatttattagttggtactaatattaaagttagtgcaggggattccggaatggttatggctacatctttagatgtggattatgcaatgatggctattgtagggatggcagcgcttataccgatgacttatttaattaattctggtattaaagttattgcattagcaaataaagagagcatagtctgtgggggtacactattgcttagtttagcaaaagaaaaaaatgttaatattgttcctgtagattcagagcataatgctatatatcaaatactttctagtagtaaaaaaaatttagaaaaaattaccttaactgcatctggtggtccattgttatcaatggattatgatcaaataaaaaatgttacagttcaggatacggttaagcatcctatttggaaaatgggaaaaaaaatctctgttgatagtgcaaccatgattaataagtctcttgaaattatagaagcttattattttttttcaataaaagctgagaagttagatataatcatacatcctgagtctataatacatgcaatagtatcttatgtagatggcgcatctattgctttcatgtctgtgccagatatgaagattccaattatgtatacattgtcctggcccgataggtcagctattttatgtaaaaaactaaatttggcatcatgtaatcaattaacatttataaagcctgacgtttataaatttcctggtataaagttagggtttgaagtattaaaaacgtctaatgttcatgctaatagcattattttaaatgctgcaaatgaagttgctgttgatgcttttttaaataagaagataagatttcttgatattgtaagtgtggtatgtgagacgttaaacttagtcaattatggacgcattaattctctatcaagtattcttgattgtgatctggtaagtagaagagtagcaagtagtgctattgataagttatattaatatattaaattatttactatattgtgtaattagtgtattatcctttctacttgattgttgggttaaatgtgtatttttcagttgttatagttagtattgttactgcttaatagtatttgatttttaaaaaattgttaactagtaaaattcgatttcttttaaatagttatatatttgttttgatattgttaaataatgcgtttacttaacatagtgtatttagtataaatatattaaagcaaataaaccatgtattataggtgttagatgtttagacgtaatatcttgaatgtactgttggtattgattttctgttttgttatttcgtgttcaaataagagtagatatcagtttagtaagaaatattctccagtttataatcctgatggtgaagcttttgatagtgatgtggggttttctcgtgcttactcaatttataaagaacgtagaaatgcactggtttcaggtattgatgaaagcagtaagaaagttagtgtaagacgtaaagtaaagccaaaagttcaagttagagatgttgacttgttaaaggaatatggggatcttttaaaagaggaaaactgtgatttaatggtagatggtaatggcgttaatttagttgatgttgcaggtgctaagtttattgatcctatagaaaatgatgatgatgttatagatcacgataatagacatgttgatgtgaaaagttcagtggtcaaaactaaagataagaataagttacaagatgttaaggataacaaacctagtgatgttaagcttccagtaattaaagctgaagataaaaataagttacaagatgttaaggataacaaacctagtgatgttaagcttccggtaattaaagctgaagataagagtaagctgcgagatgttaaggataacaaatctactgatgttaagcttccggtagttaaagctgaagataagaataagttacaagatgttaaggataataaacctagtgatgttaagcttccagtaattaaagctgaagataagagtaagctgcgagatgttaaggataacaaatctactgatgttaagcttccggtagttaaagctgaagataagaataagttacaagatgttaaggataataaacctagtgatgttaagcttccggtagttaaagctgaagataagaataagttacaagatgttaaggataataaacctagtgatgttaagcttccagtaattaaagctgaagataagaataagttacaagatgttaaggataacaaacctagtgatgttaagcttccagtagttaaagctgaagataagagtaagctgcgagatgttaaagataacaaacctagtgatgttaagcttccggtaattaaagctgaagataagagtaagctacaagatgttaaagataacaaacctagtgatgttaagcttccggtaattaaagctgaagataagagtaagctgcgagatgttaaagataacaaacctagtgatgttaagcttccagtagttgagaatatgattattgatacatctaagttaaatgatgatggtgatcataaggctgacaagaaagaaaaagggttacgttcattattaaaatttacaaaaatagaaaatgatagtaagggttctgataataatgtcgcaggtaatattgctaatgatagtgaggagcctacgttctctcaacctaaaagtgatgtagaatctcctaaacaagtatctgagagtgatgaacaaaaaaatagtcataaagctgtacactttctatcattcttaaacgagccaagtgaagatcaaaatgatacgacagaagaactacaaaatacagaagataaaaaagataatttactagaagagaatgttaaaatatctgaaaaggatgatcaacaagtagtaatatctatagaagaggaaaatcagatgttattacaaagtattaagaagatgaaagaatatgatgaagattatagtattacgtattattatgatgatgatggtatggcgtactatgaagactagaatacatttttaggtagatttgttagggttaactgtatataattttgctttgatacaaggttatgtttttgtatgcaatgtgagattgtagatagaattttaaatgaagatgggttgtttaattgtattgcaaataaaaataaaataacctatgaagtgaaagttggtgatgtagtaattggtggcaacaatcctgtagtagtgcagtcaatggcgttaggcggatctggagatgtgtataaagatgcacatgaggttttagagttagcgcaagctggatctgaattggtaagagttgcagttaattcagaacaagctatgaaaaatgttccgtatataagagatgtattggtagatcatggctttagtgctaagatgataataggatgtggacaatatgaaattgctagattggtaaatgagtatcctgattgtgcagctgctttaggaaaaatacgtattaatccaggaaatgttggttttggaaataaacgggataagaattttgaagatattgttgagtttgcaataaaacatgatatccctatcagaataggtgtaaattgggggagtttagataagtatttagcttcaaaattaatgaatgataatgcattacttatcaaccctaagccagattatatagttttgcagaaagcattggtaatttctgctataacaagtgctaaacgtgcagaagaaattggcttatctaaaaataagatagttatatcttgtaaaacaagtaaaatacaagatttaatacctgtttatacagtattgtcaaatgtatgtaattatccattacatttagggttgacagaagcagggtctggtacaaaaggaatggttagcagtgctgcaggaatatcttacttattgttaaatggtataggagatactatacgtgtttccttaactcaacaacctggtgaagcaagaagtattgaagtcaagttatgtcaagaaattttgcaaagtataggtttaagaaatttttctgcgcaggtaacttcatgtccaggttgtaatagaactaatcctaagtattttcaccaattagctaaagatattaatgattatataaagcaacgtatgcctgtgtggagaaatgataatcccggatctgaaaatatgactgtagcagtaatgggttgtatagtcaatggtccaggtgaaagtaaacacgcaaatttaggtattagtcttcctggctatggtgagaggcctgtagctgcagtgtatcagaatggagagaagttgtgtactttagaaggcggtaatatctttgaacaatttgtatcaattatcgaaaattatgttaatgtttattacaaacaatagtaaaaaaggtaatctataattatggaatctacaactggcgaaatgttattttttaagcattttgaagaattgagatatagagtatttttttgttttgcatttttttgtatcatgtttggtgtatgttacttcttttctgaaagaatatataactttttattaattcctttaatagatctagaaggtgctaattctgaattttccctaatatatactgatttaacagaggcattttttgtatatttaaaagttgctactatggctgctttattgggttcttttcctgtttttgcatggcaattttatatgtttttagctccagggttatataaaaaggaaaagttgatattattaccgtatttgatagcgacaccagtgctttttattcttggagctgcaatggtgtattattatatatttcctttagcttggagattttttattgcatttgaaaatagagatgcttcaatgggcgtaccaatagaattcatgccatcagtaagtgaatatttagatttagtattgcagctaatgtttgcatttggagtagcatttcaaattcctatatttttaacattaatgtctaggattggtatagtatctgcaaaaggtttgtcacgaaagcgaagagtagcaattgtagttatttttattcttgctgctatactgacaccacctgatgtgttaagccaaataggattagcaatacctatgttattattgtatgaagcatcaatactagcttgtaaatatattgaacgttctaaatgatgttttgttacttgtagaaatgttttttatgtgtcatggtattgtataatatattaattatagtaagtataaagtaatgagaaagattgctgagatattcttacaaaggaatagagtatcgatatttctgttgatggttatattgatatttggttgttattcttatttttatattcccaaagaaaagaatcctgaaattaaaaaacctattttatctattcatactacattgcaagggatgtcatctgaagatgtagagaaatttttagtgtatcctattgaacaagagataaaatctgtgaagggtattagtagaattacttcgatggctaaaaacggctatgcaaatgtaatattagaatttagtgcaggatttaaccatagagaagctttagaaaatgtaagatcaaaagtggatgtgatacgtgctaaattgcctcaagaagcaacctttcctataataaatgaagagaattttagcttatttccagtgttaagtatagctttagttagtgatttacctaacaggacattgtttaaagttgcaagtgatttgcaatctagattggaaagtttacctaatatagaaagtgttaagattattggaaatagtaaagatattattgagataaatatttctcctggtgttattaatagctataacttgcaaatgcaagatgtgataatggctgtattgaataataatcagtttctgaatattggaaatttggactctacagttggtaaatatacactgcatttgtcaggtattttaaagaatatagaggacattatgaatataccagtaaaaactgatggttattctgttgtaactgtaggtgatattgctactataaagccaatttatcaagataataaggaatttgttcgagtaaataatcagccatgtttagttctagaaatatcaaagcaaactggtaagaatattattgagactatctctcaagtaaaagaacttatgaataatctcaaaaatatattgccaaacaatttatcagttatttatcttcaagatgaatcggaagagatatcgaatgttttaaatgaattacagaattctattttaatttcagttttattagttgtgataattatgatggtatttatgggaactaagactgcattgttagttgccgtatcaatacctgggtctttcttgtttggtattatcattatgtatttattagggtataccttaaatatagtaattttattttctttgattatggctgttggaatgcttgttgatgatgccatagttgttactgagtatgcagatagaaaaatgataggtggtttgaataaaatggaagcttttaagcaagctgcacatgatatgttttggccagttgcatcggctactttaacaaaattagtagtatatattccattgttgttttggcctggcactactggggaatttatgaagtatattcctattgcattaatcacaactttaagtggttcgtggattatggctttgatttttattccagttttaggatctcttattggaatgccatcagtgactgataaaaaaagtgtagcagaaattatagcgataaatactggtgattttgtacatttgggtagatttaccagaggttatagtagaattttaaataatgtacttaatcatcctaaaaaatttgtttgtgtaatagttagcatattgtttttctctacgtttggatattttatggttggtccgggtgtagagttttttccaaatattgaatcagaaagaatgcttatcactataagatcaaataataatttatctgtccatgaaaggaatgacatattgcgagaagttgaacaacggatttctgatataggtgggataaaatttttttatgtaaaagctggtctgtttgagtattcattggatgtcgataatgttattggaaaaattcaggtggaattaaaaaaatgctctatttgtaggaagtctgacaaaatattaaatgagataagaaataagctacaagatgtgaaaggtgttattataaatattgtggaagaaagaatgaaaccagtcactggtaagccaatacgtattgatattagttcacgtaatgtaaataagattaatgatacaacggataagataatatctattatgaataattctttaggatttgaaaatgttacagacaatagatcatctttagaaatagagtggaaaattgatattgataaaaacaaggcaatgagatctggggttgatatttctatacttagcaaatttataaaaatgatagctggaggagtattattaaataggtatcacccagataatattaatgatgaagtagatattattctcagatttcctaaggaatatcgtaatttaaatacgttgagtaatctgtttgttaatactttacatggatatactgctgttagtgattttattattcataaagctcaacgtaaagaaggtggaataaatcatattaatggtataagaacagtaagtattatggctgatttatctcaagggtatttattagaaaagatgatcaattttttaaatcaaaaatttaaagaggaattagattcagaggtattggttgaaataaaaggagaaataaaagatcaagaagaatcacaaaaatttttaattaaagcatttgttataatagtagtacttattatgttggttctaattactgagtttaacagtatttataatacattaattattatgacagctatttttctatcaactacttgtatattttttggattttttatcacaagtcatgttttttctgtagttatgggaggagtaggtattattgtattggctggtgtaatagtaaataataatattctgcttcttgatgccttttatattaatatgaatactatatgtaataaaaaagaagctatagtaagagcagctttatctagagttaggccaatattattgacagttgttactgggattattggattggttcctatgatgttacgtgtaagttttgattttattaatcggcaagttatttataattcaccgtcaagccagctttggtttgaattatcttatactatagctattggtttatgtttagctactgtgattactttattttttactcctgcgttgcttatgatagggaaatataataaaattaacaaatgaacttacgaggtgtatagtaagtttagtgtaaggagaaattacttgacttgaatagtagttataatataaactcctaccgcggttttatctgaatatgtgtcatttttaaataatcaggtgcactaaatcttagttttttgtacataggtttttactaagggtttttatggttaatctacaaaattttgataacttagagttaataagggtggctaaggatattgctgatcagaaaggcttgaatttggatgttataataagagctatagaggaagctatccaactaactagtcgtagtagatatgggaattgtaagattaaagttacagtggataaaaaaactggtgtagtagctacttataggcaagtattagttatcaataataatggtgatattagtgttcctgaaggcaaagaaaatgagatagatttttctgatgtaagcaaatataaattgattactttagcagaagctaaacaaattgataaaaatgttgaagttggtgatataatgcttgagcctctccctgttattgatcttgattatagttctgctaagattgcaaagcaaaagattgctcaagttattatttcagaagagcgtaagaaacagtatgaagattttaaggatcgtgtaggtgatattgtttatggtactgctaagcgtatagaatataataatgttattgtagatctaaatggaaatgaaggttatttatcagcttcaaatttgataaaaggagaggtatttcgtgtgggtgatagagtaaaagctcacatagaagatgtaagaaaggaaaattcaggacctcagatatttctttcaagaatcaataaaggattcatggagcaattattcaagcaggaaatcccagaaatatatgatggaatagttacaattaaggcaatagctagggatccaggttcaaggtcgaaggttgcggttttttcttctgataaaaatattgatccagtaggtgcatgtgttggtgcaagaggtgtaagaattcagggtattatttctgaattacatggagagaagattgatgtgattttatattctccagaacttgctaaatttatagttaatgctatagctcctgcagaagttttaaaagtcattattgatgaagataaggaaaaagtagagttaattattcctgaaaatcaactaagtttagcaattggtaggtatgggcagaatatcagattagcatctgagttggttggttggaaaataaatgtaataggagatgaaactgaatcaagtagaaaagcgaaagaattgagtgcaggttcaaaaatatttgttgaaggattggatgttgaagaaataatagggcaattgttatttactgaggggtttgttagtattgaagatatagatcaagcatctgttagtgatatttctgcaatagatgggttcaatgaggaaattgcagaggaattaaaaagtagagcagctgattatttagtgcgtaaagatgctgaaatgaaacagattttagataatttatctgttgataaggatgttactatgttaccatttttaaggccgagtgatattatagcgttgtcgaaaaatggtatcaacagtcttgaagatattgctggattgtgtacagatgagttttttgatattattcctgatattgcattgactaaggatcaagtagactctgttatattagagtctcgtaagaaaataggatggttataacttttgttttttgggtagttgtctatgaatgagtctaaaagtgttgtagatagtgggttgatgtcaggtaaaattgaacgtacaacactcaagcttagtgataagttaaaactgtcttcaaatatacatcaaggtacaaagttttctttaaagaagtctgtgaccactgtagaagttcgtaaaagtaaaaaaaggaaagatattaataatattgaacaagcttctgtagtattgcaaaatgataatgcttaccaggataatgaaagtaataattccttaactatacaagagcaaatttctcgtatgaatgctctacagaatgctaatatatgtgaaaaaaaggaagatatcaaagaagatacaagtgatgttaatcttcaagtaacagagtcaacatctgttgaaaaaagtgaaagtgatgatgttactcttgaggaagagagtagtaaaaaagttgaagagcaggtagttgaagaggctcatgataatactgatactgtatctttgaatgttgttgaaaatgtacaagaagagagtcaggtagataaccaagttgaaagcagtaatataagtgatatattgcagcctaaaggcattgaagagaaaaaacttaaaaagtatgaaaaagagcatgaagaaaagaaaggaaatcctaagaaaggggtttctaataatatgtatagtaagcatgtaaaattagtaatagaagaggaattagaagataataataagcaggttattcaaacacataaaagtaggaagaatcgttctactagttctgtaaagaataaaattactcgcaaggttcttatacctaagaagattactgtacaggagttagcgagtagtatgtctgaacgagtaaaagatgtacaacatatgttatttcaaatggggagacgtgatattaagccaacagattttttagattcagatcatgcttctgttattgtagaagcttttaatcatacttttaaattagtgaatgatggtaaattagaagaagatttatatgctgatggtaatgataaggaattacttcctagagcaccagttgtaactgttatggggcatgtagaccatggaaaaacttcattacttgatgctatacgcaaatcaaatgttgcagatggggaatttaaaggcattacacaacatataggtgcatatcaaataatgcttgatggcgataagagaattacttttattgatacaccaggtcatgaggcgtttactgctatgagagcatgtggtaccaatgttactgatatagtagtattagttgttgctgctgatgatggtattatgcctcaaactattgaatcaattaatcatgtaaaagcagctaatgtagcgatgatagttgcagttaataaaattgataagcatgatgctaatattgataaaattactaatagtttgcttaatcatggagtagttgcagagagtttaggtggggatgttattgtagttcctgtatctgctaaggaaaggataaatttagatcaattgaagtcaagtatattattaatggcagagttattagagttgaaagctgtttatgatactagagcatctggagtagtaattgaatcaaaagttgatagaaattgtggggtggtagcaactttaatagtacaaaaagggacattaaaagctggtgatattattgttgttggtcataattcatatggtaaagtgcgtaatatgtttaatagtgatggaagaagtgaaaaagttgctattccgtcaatgccagtaaaagtgttagggttaaataatgtacctaactctggaactaattttattgttgtggattctgaaaagcaggcacgtgagttgattagttatagacaagagttatttaatgcagaattagaagcaaatgcaaaaccaaaaatggatgctaatagcatattagcttgtggtgtggttgatgagttaaatgtgattttgaagtgtgatgttatggggtctgttgaagcaatatgttattcaatcagtaaaataactcatgaggatataaagttgaatgttttatataagggtgtagggaacgttacaaagtcagatgtgttattggctgaaacatcgaattctataattttagcttttaatgtcaaaacagatgcttcagtaaaagaattggcaaagcagaagtgtattgaaataaagcattattcagttatatacgatataattgatgatgtaaaaaagatattaagtagtatgttaaaaccattacagcaagaagtgcaagttggtactttatctataagaaaagtgttttcttctggaagtataggaagtgtacttggatgttatgtgacaaatggaatagttaggaaaggtgctttagtaaaattgattcgtaataataatgttattcatgaagggaaaattaaggttttacgtcgttttaaagatgatgtaaaagaagtcgctgctgggtttgaatgtggtattttgttagattattcaaaagaaatatatccagaaagtgatataattcatatattagagatagtagaagaaattagagttattaaatgatttataaatctgaaagttttaggaatttaaaagttgcttcagtattgaatagggcgatatctagagtattaatgcaagatatttgtttgtttaatagtcatataactatatctaaagtagaagtgagtagtgatataagagatgctactgtttttgttataatttctcaagaatgttcagataaagaagcgcttataaaagaattaaatgactcttcttattttattagaaaagcaatattttcttacgtagatcttaggtatatacctagattatattttaagctagattattgttttgataatttggttagagtaaatcaaatactagaatctaagtaatgcattctgctgctgcaggtattaaaagcaatatattagaatatagtaaaaaagaatactattatattcattgttttacttttttttcctattatatttattccttcagtaattatagaaaaagcagactcttaagtagatcttaggtatatgcctagatatgtttttagcgacgagattattgttttaatattttgttagagtaaatcaaatactagaatctaagtaatgcattctgctgctgcaggtattaaaagcaatgtattagaatattaaagaatactattatatttattattttactttttttcttattatatttatcccttcagtaattatagaaaaagcaaacgtaaagtataggtagttgtgtgatactttaatgtgtattccatttagtgttaagagtatgcctaatactaatacaaacataatggctatagttttaatattactatatgtggtaattgcttttatgatgtaatgtgaaaacaaaattgtagatatgatagaaacaacaaatactatttgaataataagaatgttatgtgtaattcctatggcagttagtattgaatctatagagaatattaagtctactattattatttgtagtattacataataaaaatttgattttaagttatgaattttaccatttttcttaaaaatatcgttccatatttcagataagctttgataaattaaaaatattcctccaaataccataaataaattattaggagaaatatcaagttgaaataatgaaataataggattattcatagctagtatagctgatgctccatataatacagcaatacgcattattaatgctaatgataaccctatatattttgctttattacgtagttcaggtaatatttttgtgacagcaagtgagataaaaattatattatctactcctaaaattatttctaatatcaataatgtaaaaaattgagttatataactttccatatctgatgctttataggatgttaatgttgtatatattatatgttatttaatgcatataatattaaaaatgtattgaatattattgatcctgtaatgcttatatttttattttcaacttatttttaattcttaggtggtagagttttttaaattatgaaattggagatgtcagtgttatcaaagaatctagaagctagtttacacaaggcactgtcaattgcatttgattttcatcatgagtatgctactttggaacatcttttattagctttaactgatgatatagatgcaaggcgtgttttttatgcttttcgtgtatcaattgataaactgaaaattacaattataaattttctgagatatgaaatacctactttaattgataagggtatttcagaagttaagcctactgctatttttgaacgcttaatacatagagctattatacatgctcatacttctggtaagagtgaggtaacaggtgcaaatattcttgctgaaattttatcagaaaaggattcttatagtgcatgttttttacatgaacaaaatataaaatacatagatgttgtaaattatacttctaataataatttatatgctggtgagtttaatgtagatcaggaatttgtaaaatataacgagtatggaaaatcgataggtaacgtaaataaagatatattgaaggataatgaaactctagatagctattgtgttaatttaaatgaagcagcaaaaaaaggaaaaatagattatgtaataggaagagcatatgaattagagagaacaatggaggttctattaaggagaaggaaaaataacccattatacgttggtgatcctggagttggaaaaactgcgattgttgaaggattagcattaaaaattatagaaggtgatgtaccagatcagttaaaaaaaatggtaatatattctttagatatgggtgcattattagctggaacacgctatcgtggagattttgaagagagaataaaatctgttattaaggcaatagaagcaaaggaaaatgcaatattgtttattgatgaaattcatacgattgttggggctggatctactagtggtggatctcttgatgcaagtaatttattaaagcctgctttagctagagggacattaagatgtataggtgctactacttataaagaatataataataattttgaaaaggatagagcactagctagaagatatcaaaaaattaatgttgaggagtcatcagttggtgaaacattaaggatattagatggaataaaatcttattatgaatcacatcatcaagttaggtatactaatcaagcaattaaatatgctgcagaattatcggacaggtatatttcaggaaaaatgcttccagataaagctgtagatgttatagatgaagcaggtgtatattgtaaattgcataacactggtaataaagttattactggaagtgatattgagcatataatttctaggattactgaaataccatgtagtaacttgttgtttaatgatttggatagagtaaaaaatttagaagaaaatctaaaaaaagatatatttggtcaagattttgcaatttctcatcttgtagattcgattaaaattgccaaagcagggcttagaaattataacaaacctttagcaagttatttattttctgggccaactggagtaggtaagactgaattggcgaggcagttagcaaatcatatgggtatgaaattaataagatttgatatgtctgaatatatggaatctcatgcaatttctaaaattatagggtctcctccaggttatgtaggatatgatcaaggaggattattaactgattctatttcaagacatcagtatagtgtattgttacttgatgaaatagaaaaggctcacagtgatatatataatatattactacagataatggattatgggtgtgttactgatacttatggtaaaaaggttaattttcataatgtagtaattatattaacaactaatgctggtgcttttgagttaagtaaaagttctataggatttattagaaataaaagttttactcatggagataatgaaaaagcaattgaaaggatctttagtccagaatttcgcaataggttggatgctataatttcattttcatctttagatcaagaagtgatgttacgtatagttaaaaagtttatttatcagcttaaagagcaattagcaaagaaaaatgtgcatatagatgtagctgatgatgtgttaatgtatttagctcagtctggttataatgatgcttatggtgtaagaaatatagaaaatattatttctaaaaaagttaagaagtatttagcagaagagatattatttggtaaattatttaatggtggaaatgtaaaaatcaaacttgatgctgatactaataagttagtgtatgatttttgttgtgcagaagcataaatttaatatattaaagatattgcttaaatataaaatatatattaaaagtaatgtattatctatatcaatgaactttattttataagtgctatttttataaatattaatgatcaattatatatcttttagatataataatattaattgataaatgtctatcataatatagttaaaatactagtaaatatattataaacacacatatattatttttcttttttaataataatcaactttttattataaaaatcttaatatttattcttgattaataaaataataggtgttagcatcaaaattaatatattaaaatacaacttaaagatgttaaactttaataaaacattatctaaatattattcaattgttgcttgtattgcattttttatgttattggtgcttttaatagtacatttgattagagtatttttgaaaaaggagagcgttattggtcatctagtaactggaattcttgctttatcattactatctattattctggtttttggatctaaatatttatctgatcaccttgaatttaagaataaattattagtagatttatttacagaagagcataaggaaaaagtagaggtacaacagattggattgaatgaggattttgaacgatctataatgcgattattagagttaaagaaattagcattagaagatatttctgttgactttgcagagtctacgcagcacagtcaatcaattttagaaaaatatgatagagaaatagaacatttggaagctctgcaaaggagacaagtggaaataatagaactatcaaatagtttaggagataaatttcaactacaaggttgggagtatgatacaagtttaaaacatatacaagataattttatagagcatattaaacatgaaagatattcacattattgtttttgttgttatttacatgaatttgaggttggtgatagtgtagattttgatgaactttcacctcgtgtgagttctgctatgatatatattacttcttcaccacctataacatgcatttttaaatcagcaggtactttattgactgcgatggggaaattagatgcagatgataatacgttatttgttgagtattgccaaaggttatataattttgattgtaagatggctttacaaattgaaatatctttatctaatagattaaaatgtgacacatatacatataaccatattgactattggataaacagtactagatcatattatagacagcgtgatacattagctattgctttacaagaaggtaaacatttgttgacatctcttgcagatagagaatattcagatacggtttcttcttttaaaagtaggggtatagaaagtacgataagtcaacttgaaaatacactaaatacgcaattaccaaaaggtgagatagataaaattatagagggtagtaacccaattatgcaaaaaatagttagggagttgaatttttttggaaaagataggatggaaacccttaataacgtacaatcagaattgccagaaacattattaggtaggaagattattgatgtcattgaagcagaagaagaattaaaaagtttgattgataaaaaatataatttaagtttagaagatggtcctaaagggaagataaggcagatgatgtgttatcttcaatcaaggtttgatgaagtaaaagatggtttgttagcatattcgcctatgctatctcaggatatttctcaaatacaagcattattagatttagatttgaaaagtagtcctttaaatttgcaatttgaaggtcagcctttaaatttagaagatgtggaaacacaaattacatatctatctaaacgattgtttagggaagaggaagatcaaatagaattattacaatgtgttcaagatgcaatccaatgtactaatggtaaaatgcctcctgatcttgaagagaattttttattaaaatcattagatattattataaaatattattcagattttttacaaggtatacaaacggtattttctaatcagagcgtagcaaaagatgaagtagtgtattgtgaacatttactaaatacaaagtcagcgagtttacaaaaaatatttgatattttatatacgagatatcaatatttagaagaaaattactgtaatcttgaagaagcatcattgaaattatctaaagtacaaacattaaatgcgcagtggttagttgcatttaaaaatgtggaacatgttcatattttatttgagaagttattaaaattggaaagtcaatatagcgcttttcaatatatggtgactagattacaagaattaatggaggcagtgttaggagtcagagatggatcatcttatttacatttattggatatttcagaagatgagaagagtagttttttagctgaactaagtcaacaaaaagaaccaatagaacttttgaaattactatctatgaaaaaagtggagtttagtatgcttaaaagcgagaaactgaaccaattagatggaaaagttcaagctattagtaaatctttatttacttttatagataagagagatgaaatattagtgtccccgattgttgtacagcatctatttaatgagggacgaatgggagttcattttattagtaagttagaaaagttaaaggggacattaacattattatctaatgaaactagacagttgatatttggtgaatatgtaaatgatattgattatattatagattggataaggggagcagtgaatgtcttgtataacaatgataatatttcagtgcaaaagggagaaattataaaaaattatttagaatatttacaacagaattttttaatacacgataaattattaaatttatttaacttaaagaaggaaattaaaaacaagaaagaatcattgcttcctattttagatagattaaagatagcgcttgtgcaaaatgaagagctagatggtgaattagtaaacttgaaaaaagaaattgatgatctaatttgtcaagttaatcggcaaatgctgttaataatagaaaaagatggtgaattcaaagaatttgtcgagttagtgtctggattattaaataggattgatcataaagatgatataccagaatttctatattgtatggaaatatttgatgattcgttagctaaattagaaaggggtatagattgtacaggtgataaagagaattatacgaaatatatacttgaaaatctaagaaacatttctagattatcaagtgaattaaaagcaaagcaaactgaaaaattaccattaggtggtgaacagtctgaattaattgaagaattagttagtattggtcaacaggtaaatattaaagatcaattaagtgtacttgatgatttatacagttttttggatgtagcaaaatacttgcaggaagagtttaatagcttatataaagaagctatagagtcagtgctagaaattgtagatgttgaggaagaggataagagttcttttgtagaattagtaaataataagctgaaatctttaggtaacagtttttcttcatcagaagttgtgagtagttttatgcatcaagaacgtcaagatgtgagtaaattggggcgattagaaagttatatatcaatattaaaagaagaaccaaataaccttaaacagctggctgatcaattgctaaagttttcatcatttactttaccctttacgggagaaaggctgcataaaactttacaagatatgacgacactaaatacactatatgaagttactgattatttaaaaacatatatttctaaaagtcgatatatagaacttgatcaattagagggtgaattgcgtaaatttgtagagtatatgataaatactgtgaaaagtatcttaccacctttacatgaatatgaaaaatctacctgtggatgtaaaagctgtcaaagggtagagcaagaaatgacattatattttaaaatagcaaatgatcttgacgacttgcaaagcttattacagcaagaaaggaaaataataacatttggtgctatacaaaaatttcaagaaatatgcaaaaatatgaaaagtatgtttttagaagataaagatttggttgattccatatcaaatatactgttacacagtgagcactgtaaaaaaatgttggggttagattcatataccactcactttttattatatattaaatttttaatttattctgtaattgaagtaggttttagtatagagcaagatatggttatggagttaaatgttaagatatataggcaagaagtgttagtttcagaattaaaagcaaatcttaggaaagagttagatgagaatatacgaaatttattagatcagccaatatattaccctaaagatttaatcaatgtaagattaataaagagaagatttatagataatggaattatatttgatgatttgatgaaaattttggaagatagtgtaaaagaaaaagtacaatgttcaagtagtgcattagtatccttgatgtgcaaggaaagaatagatagtatggaatgtttgattgatacttatcaaagtgaaaaagtatcatattcctataaattaaagttatatacggcaattcaagagtttatggataactctgtagatcaaagaaatattcaatatttaaaagaaattgatgatggtatacgacaagtgcctaatgttctgctattttgtccagggaatatactactgaaagcgacagatattcatgctctataatacatatttgtataataaagtgttgtggtgttcatgaaaaatgcttttttgtttttattataataatgtgacattaattttataaatacacaccatggactgcagaagaacgtgaacaccagttatttaagcgtgaaaaatatgtggaatttaatttgattcacgatagacaaaatttggtttactaccaaattggtaactctggtgcaatcataatatctatgcctcctaagtcaaatgaaagtaattttatattatgtaaatttcaaaatagcccatctaattctgatgatcataaatatgtgtactttcatgatacacactttttattacatttttaatgttaataataaatatttagttttcaaatttattttaacattaaaaggtgatatttactaaatctcaactgttgaataaaagtcaaatgtatatttcctgttttcttatagataaaaaatgtaatttttattatatttttatttacattttataaattatttcttaaattctaaataacattaattttataaatctaatgcggcttttgcttttttaaagtagacgtattgcctaattattttaatgatttaataaggacacatgataccaaaagaaacagtggatatagatgaaccttccataaatcaaaagttgccattgaaaaaaataatatgccagcaactgatcagaataagtacattatgcacttttattgcgctttttgcttttcttgtcttaacacttgtgcttttcatgagtaagagcaaggatgcagaatatataaagaatataaaaatgtccgctgtaatatgcctaatatgtagtattgccccctttataatagttaatattttccagaacagtaataacagaaaaggtcaaatactaaatggtagtggacaggaaaatgacatgctaccaccatctacttcaaacactttccgcaatacacttactatactgagtacaggagtcaatataatacacagtattgcaatactttgaatataaaaaaatattaaagctagtacttagaggcttagcataatacatataaaactacaatcctccataattcattgcaccaagttaaatttgtcatgcaaaacacacaacaattcagtattatatacatttttatgtaatatgcaatagaatattttttaatttataacaaaaatatagttgccattcctaaaaagattaaaaaagataaagtatcacttgtagcacatatgataatagaagaagatattgcaggatcaattttaaaaagatttaatatcattggtatagctgcacctaagaatgttgcgatagaaaaagtgattatcattgaagttcctgctaatacttgaatatcaacgtgttgtcctcttaacatgagtgctatcgaagacacaatcgctaatattaagccattaatgaatcctacaaataattctttaaaaagtaatctgtgagcatttctattagtaagttgtttagtagataaagctctgattgtcactgtcaaggcttgtaatcctgcattaccactcatagatgcaataattggcattattactgatagtgctataaaatgttgtaaagtattactgaatattcctatgatcattgaactaattgtagatgtaagtagatttattattagccatggtaacctttttataacggtttttgaaagagaagaactcatgtcattatttgataccattcctaagtgtaaaacatctttttcagcttcttgatgcattacatttaatatatcatgtactattattgaccctataattcttccatctctgtttatgactggagctgataataaagaatattttctaaaaatttctgcaacttcttcttgtgtagtgtgtgattttatgatttttatatcagttttcatgagatttttaatgatttgggtactgtttgagcaaataatattgtctaaccttaagtatcctataggatttagtttaggatctacgatgaaaatttcataaaattctttatttagtttattattttgttttaaaaaatttaataactgatttatagtccaatattctggagcaataatgatatctttatgcattaacctaccagcactttcttctggataggatagcaattcattaacatgaattttgttgctttttggtaatatatttaaaatgtttatttgactttccttatcaagatcttcgataattacaacaatgtcttctgtgcttaactgagatattaaagatgctaccttttttattcctaggattttaattatctcttgacgtaagtctggaacaaggtggataagaatatcttttattaagttatcatttatactattaaaaaattctttacgatgttgatatgttgaagtgagtaagaaatatgcaagctgcacattatctgatttattaattatttcttctacaactaggtaattttgtgtttctaatgcttcagttaaagagttactggttttttcatctaatatgtagtgtaaagcatggccactttcctgtgtgtacataataatatagcccttagattattcacaaaataatataaaaaattatcaataccaagtatatacagttatatagataaattctaaatacatttttaatgttaataataaatatttagttttcaaggtgatattcactaaatctaaaccgttgactaaaagtcaaaatttatatatggtatttaatgtttttagcccctatggcggaatggtagacgcggtagactcaaaatctactattcgaaaggatatgctggttcaagtccggctaggggtacttaaaaataaattgttagttgttgcaagttttttttattttattacaatactggtgagtttgggtaatcgttaatgggtttttcccttggtgtttttttattgtaaggtatgagatgtcgggtttagctagtaaagcaaagagtagggttaagagtagcaaaggtaaaaatagcacaaatattcatgctgatgaattaaacgaagatgttggagtagtagttcgtgttatgacagcagtcgtagatgtaaagtttgctagtggtaaaataccaaaaatacttaatgcgttagaaagtaaagaaatttataatggtaagaaattagttcttgaagtgtctcagcatattagtgatagtattgtaaggtgtatagcacttgatggcactgatggtttgtctagaaatgataaatttattgatactggtgctcctatatcagttcctgtagggcgtggcacattaggacgagtttttgatgtactaggtaatacaatagatgaatgtggcccgttagaagaatcaagttactttattaagcaaatatattcagagattcctaagttaactgatcagaaaattgcaactgaaatattggtgactggtattaaagtaatagatttacttgctccataccttaaaggtggaaaagttggattgtttggtggtgctggtgtaggtaaaactgtattgattatggaattaatacataatattgcaaaagcacataaaggagtatcagtttttgctggtgttggggaacgtacacgtgaagggaatgatctttatcatgagatgatagaatctggtgtaataaatttagaaaataaggatcagtcacaggcggttttagtatatggtcaaatgaatgaacctcctggagcaaggttaagggttgcattatcagctttaactatggctgaatattttagggatgctgaaaatcaagatgtactattttttgtagataatattttcaggtttactcaatctggatcagaaatttcagctttgttagggagaataccttctgctgttggttatcagccaacattggcagcagaaatgggtgcaatgcaagaaagaattacttccactaatagtggatctattacctctgtacaagcaatatatgtaccagcagatgatttaacagatcctgctcctgctacttcttttgcacatcttgattcaactactgttttgtcaagacaaatatctgagctagggatatatccagctgttgatcctttagattcaacatctcaagctttatctgctgatgttgtaggtaaagagcattatgacgttgctaaggaagtacaacgtatattacagacatataagtctttacaagatattattgcaattcttggtatggatgaactttcagaggaagataagcttatagtggcaagggcaaggaaaattcaaaggtttttatcacaaccttttcatgttgctgaagtgtttacaggtgctcctggtaaatttgtatctcttgaagatactgttttaagttttaaaggattggtagaaggtaaatatgatcacttgcctgaagctgcattttatatggttggtagtatagatgatgtcataaaaaaagcagaattacttcaaaaggaaggtaaagtttaatgaagtatctctctgttgaatttattactccagatgcttttttagaggtaacaaatgttctgtctattacttcatatactgtagatggagaatttgtaatattacctggacatgaaaaatacattatagagctgcgctctgggattattaaactaaaagttgatacaggtcttagtttattttatatattaaaccccatattaaaggttgacttgtataattgtaaaatcttagcgaatcaatttataaatgcttgtgatgttaatgctgtaatacttaaaaaatataaacaagatatagagaagatattgcattgtataagtgataaagcattacttaaaatggcacaaatgcaattgaattttataaatcaaatagtcagttagtatgaaaatattccttgataccatagatatagattttctaaaagagtttagtgttactggtttgatagatggtattacaactaatccattgttgttatcaaaatcaaatttggaatgttatgatttgattgtaaagatttgttcactgataacaggtcctgttagtattgaagtgatatctacatcttacaaggatatgattaaagaagggttggaaatatctagaattgctggtaacgttgtagtgaagcttcctttgacttatgatggattaattgcatgcaaagttttatcttgtgaacataatgtaaaggttaatgtaactctttgtttttctgtatctcaggcaattttagcagcaaaggctggtgcttattttatatctccttttgtaggaagaatagatgatattggacaaccgggtatgcaattaattaaggatatacgtgatgtttattctaattataatgcatttaatactgagattcttgtagcatctgtacgtaatattacgcatgttatacaatctgcaaagataggtgctgatatagttacgattcctccatctatttttaagcaaatgtttatgcatcctcttactaataaaggtcttgaagattttttacaaaactggaatgcatctggaaaaaaaatattttcttaataaaaagttaatataagttttttatctttttgttcaataaatattatattgaagtaatatttatcctgtgtttatactcgtttgttcatagaaattatgaatatccttgcttaactatattatatttactttagacagcattatactagtataatgctgctaaactaaagttctattcgttttataatttggttttgaataattatttatgttcaagtaaattgtggtatactgctatatatggtagaatgagaaaatagcatgtccctttccaatcttagttcaaaagatgaaaataatgtagttatcgaaaatttgaaacgttatatagaaagaattgagaagctagaatctgagaaagaagaaataagtcaatatattagaaaagtatataatgaagcaaatagtaatggatttaatgcaaaggtaatgaggcaaatagtaaaattaagaaaaatgaatagtgatgatagagaagagcatgaaatgcttttaatgacttataaaagagcacttgggatattagttgaaattgatgaataatttttttgtaaagtaataactacttataaaaaataaaaaacagtatgagtttaaacaagttttatgtattctctagtattgtttttgaagttttaacgcctaaatgttttaaattttcagtacgtgataggatattaccatgtccttctgatagttttttcattgcatcattgtatacattattcaggatatttacttgttttccaagtttttgcatatcagatataaatcctactatcttatcatataatgctccaccttgacgtgcaatttccatagtattacgattctgacgttctaacctccaaacagattcgattgttcttaaagttgcaaataatgttgatggacatactattactatttttttattccatgcataattgtgtagcataatatcttcttgcattgcaagggaatatgcgccttctatagggataaacattaatacaaaatctggagtttttaatttttctatattttggtattttttatttgatagtacattaacgtgtacccttatggatgttataaattgtttgagaaggacattttttgattcctctgattttgttgcaaaatatttttcatagtgaattaaagatattttcgaatcaataattaaatgtttgttttctggtaaattaataatagcatctggttgttgtttgttaccttcactatcttgtaaatccataccggtgccatgcaagacataatcttgatttttccttaaaccagaactttctaatattttttctaatatcatttctccccagtttccttgaattttaacatttccctttaaaacatcagctaaattttcagcttgcaaagtgattttttcatttgcaagtataatcctctgaatttcttgttttaataagaactgttccttattatgtatactaaaggaatcatcaacttgctttttaaataagttaatatgttcttgtaatggatttaatattctacttaaactttcttgagatattttattgaatttatctgttttctcatcgaaaatgcgatttgctagattttcaaaatataacttatatttttcatcaattgttgtgaattcgtttttatataagtcaagtgtatgatttaaagcctttttttcaaattctaactctgcaaccttattttgtatattttgtaatttagtaataaatccatcatttttgttttttaagttatcattttcatattctaacttcttcacttgcttttctaaatcatttttaagcatgttaaggacttgataatcaaatttcgatactctacattttaatgcaatagaataaccaattaaagctatcaataatccttctaagacacatatcagagctattatcatatctgttttatatttatgtattttttacataatacaagaaaaaaaataattattctatatttgtgcttatagtaaaactttattataaataaagataaatttattaaatttttatatttatttattaaaatattatatataatgtctaattattaattaataattagaataaaatgatatttcacatagatggtgtagatgctgataaatctaagcttttgaataaacttattacacataaaaattatatatggttctatcggtcaatatgtattggcattattacaacagataataagtttgttttactaaaagacgaatcaattcctttttattatgaacaacaagttgtaccaagttatatattttttatgaaaggtagagaagagggtgttaaagtatggcattgtgttttaattaaaggatgtcaagtcagccaatttgtagataaaacttccattattattaatatggaaaaggaaaggaatcctataggaataattgttcatatatgtgatatacaagattatggtgaaataatatattccggtataggtaaaatgagtatgtctaatttcaaaaaaaatcttaaagacatatgtaaaagtagtgctaatcctcaattaagtactgttacttttccaattagttattggagtaaattagtacaaaatgttgtagaaataattccgatgcaaaaaataaattatacaagaattaacaataactaatttccagctaacttagaccttaattttttatgtttgtgtattgaaattagaagctattttctcaattatcatttattcagtaatatttgtcatactatataaattaaccatgttatcgttatttgtaaattgtaatagggcattatatgtattttaactgttatgtactattactataaatttagtgtgatataatggataaatttaaataccattacttctacagtagtgttatttatatgtttgtattatgtattatgtagaattttatggatgatactcaaactaatgacgataggtatattggaagtaatcaatattttcaagatgcattaaactggtattgtggtcgttatttattatgtattactgaaagagcttggttgtttgtaatatcactttttttatcttctatattactaatactaatacttgatatattttcatattttccattaaaaacaaatttttcctttaccaaatatacagatcattacacagatgagttttctgtaataaaaaagttgagtaccaataatgaagacagtgaagagacattgttatcacaataccttgttgcacagtatgtaaaaaaatatgaatcatatctatacaatgatttggatagtcaattcaatttcataaagaataattcttcaagaaaaatatatttagcatttaaagaaatgatagcttcccatcattatattgataattcaaaatataatgcaatatcaattgaaacaacaattcataatgtgaagcttttatcaaaagattttacttcttcaaataatgccattgttacttttaaaaaacaaattgcgataaatggtgtaatatcacatgttcaatcttataaagtactggtaaccttttctttatctagtattaaaatggctatatcaggaattatgccattagagtttcttgtacacgactataaaaaactagattaaagtcgattaaagcttataagacaagacataggctttcattataactatgattaaatttactccaattagagttgcatcacactcatacgaactttatgtaaatttgtattattaaggtttgtatctttaatgagcatcatttacaagatgcatgtttgtattgcttaaattagcattataaaaattagcaaggaaataaggaaatatttgatacttccatgttgctattgcttaggttacttcctgatatactgatgaatctggatttactgcgttataggatagtatttgtaagattttaaaattaaatttttgaattatttgaattttccccaaagaagtttgaatctagtaaattacaatttataactttttatctatttattttccataataataattatgtaatttttattgataaaagttttgaacaaaaaagtatctattatcatatgttgatgtatattaaattatatatgtatttttgtattattttgtgatgtataaatttgttttaaaaatctttgttcccataattcttgcagtaatttcatattatataaatcaatcatggataactgaattggctaaagcgttgggagatatttttattaacttactcaaactaattagcttaccagtagtatttttttctattacatcgacaatttctggattggcaaatttgacagaaattaaaactttaataagaaaaaccatattttatactatatctactacagtgattgcagctactgtaggtcttatcacatacctattaattgatccatcaaaaaaagaacttatatataacatattgagtaccaataagcatattagcaatactccagattatttatcgtatttaatgtctatattaccttataacttcattaaggtatttctagataataatgtaattgggtgtgtcatacttgcattccttataggaggagcactgctattattgcctgataaaaataaacgcgaattgcttcataaagtttttgatgccctcttcgatacatttttagaaatagcaaagcttatattaaagctaatgcccatagcattatggtcatttattactgtactgttatataacatgaaggaaggatataacatatcaaatgttttaaaatatctgttatgtatcatgatagcaaatttcatacaagcatgtataatactgcctctgttactaaaattaaagaagattcctgttataaaaacatttcgcggtgttttgccagctttaaccatagctttcttttcaaaatcttctacagctactctaccaacaactcttcgttgcacacaagattacttaaatattccaaaaaagatatcatcttttatactgccagtttgtacaactattaatatgaatgcatgtgctgctttcatattaatcacagtattttttgtatcagaagttaacggatacacattttctattggtgagatgtttttgtgggtgttcctagctactggagcagctattggtaatgcaggggttccaatggggtgctactttatggctatgagttatctcatgtcaatgaaagtgcctttgagtatcatgggagttatattgcctgtatatacaataatagatatgtttgaaactgcaattaatgtatggtcagatgtatgcattactcagatagtacataaagaatatgatgcgttgataaaaaaaggtaagaaaattggaataaatgatcaatgaactatttttagtatgtatcttaatatataagctattttagtaaatatgttaattttaatttcagaagtatggtaagtatttgacttaatttgataagtagtttttagagatcacaatgactttaaaaatagctatatggaatgtcaactctattagaaaaaggttggattaaggataattttaatttatgcttaatttagataattgtttttgctgttcatagaattcttctttatataatgtaggatttatcctataatctgtaattctagattgaggaaaatagaaagttgatgattcttttatataacatgataaaaaacagttcttatgttgcttaaaacttgccgtatattgcttgtcttttctcataaaaaataaaagaaatacaaattagattgtaattatatgtttcacttctttgtatagtatacaggaaatctaatacagcaaatactaaaaaagctaatttagatataaaagatataatagaaaagcggttagcaagatattcagtaataactcaagttatattattattttttttttaagcacatataataactaatactaaatcgcactaaaaatagctactaaatattagaaattaaaatgtacttaccaaaataatttattcttctgtacaaaaataataacaagtactattgcacgacatactacacaattaataaataattgaataacatcagacaaaataaacaggaattcttgaattattgatatccatactgaacatatatcacaacaactattacaaaaaagattatatgctttatgttaattagaactatcaaagtttttctcaaaataagtttttgcaaaatattactatccgtttatattaaggcactgttttttattattatacattcttttttaatggataaaatttgtagcaaattgtcaatccaatagagtcaaaaagtttattcttaatagaacattcatttttgataaattcttgctatagatgtatactagaatttattactagaaaaaaggattttattcagataaaaaaggtagaaaattaatcatctatatggttaagcataacgttttagcaatcttgattaatcctagacgaagctgattataactcttaaaaccaggaagatcacattttagtaaatagtgtcagtttacattgcaatttatcatgtcttaaagatgtatgatggattattaatattacctcagtactgtatgaatttcatatataaattattaaaattatttgataacttcttgattatccatatattttcttaaaatatgcggtattgttatagaaccatctctattttggtagttttctaaaattgcaataatagttcttcctattgctaaagcagaaccgtttaatgtatgtacaaatttacttactttaacattattaattatagtagtatatttagtattcattctacgtgcttgaaaagctttacaatttgaacaactagaaatttctctgtattgattctgacttggtatccatacttcaatatcgtatgttatacttgctgaaaaacccatatctccagtacacaacatcattactctatatggtaattctaatctcttgagaatttcttcagcaatttgtgtcattctttctaattctggtgctgattgttcttcagttacaatgctaactaattctactttattaaattgatgttgtctcatcatgcctcttgtatctctaccagcacttcctgcttctgatctaaaacatggagaacaagcagtaaatcttagaggtaaatcacatccattaatattcatatttgataccaaattggtaagtgctacttcacttgttggtataagtctaaaattttctgttgttttaaaggaatcatctgcaaattttggtaattgtcctactccatacatagcagattcatgaactaatattggatgagatatttctgaataaccaaattctttagtatgaatatctagcataaaattagataaagcacgatctaattgtgcaagctgatttttgagtattacaaatcttgatccagaaagttttgcggcttgtttgaaatccattaaatttagattttcccctaattcataatgagtctttattggaaaatcaaagcttgttttattcccatgtcttctcaattcaacattactgttttcgtctttcccaataggtactctttcatctggtatattcggtaacatattgagaagattaactaattgagaatcttcttttatcatattgttaatatcgtttattttacttgttacattttttgataattctatttgtatgttgcactgaagattatttttttttaacttttcaatctcttgagtgatttgattacgttctttctgtaaagagtatagttgtgttaataaatgtcttttcttaacatctaattctataattttttttgcaactttttcagaatttcgtacttgcattgcattatcaaataattctggattctgttttataaaatctatatcgtgcataaaattcaattatttatataatattgtatcttatcttatacgtggttatgttaaaaaaaaacaaaaaatcttaagtatatgttccgtttatattaagacactgttttttattgttatacattctttttttgaaggacaagatttgtggcaaattgtcatctccagtagagtcagaaagtttattctcaatagcatcatttaataaatccacaatttcaaatggaccatatttccagtcacatgctaacttcatggctttatcaatggctgatatcgaagataattcaggaattaaagatgaaatatagattaaagtattagaccatacataccacatgaattgcccatatttatcgtgaatatcaaatagatcttgaatgtttttaaagtcatgattaataatgtatgcttttctatatagtccagtatgtaaatctataacctgattactattgccaccatataactcataaaaacggtaaaatccaccaattttgcttgtagagccagtgtatccatcggaaatcatttgtagtactactctaggtatggcgttatataatttatgtaagtgatcattactgggtaaactgtttattaaatgttttactgtaagtatgaaattgtctagacctatttcatctagtaaattgaatgccccattaggtattcccatgtatttattcgttataatagaatctgcatcttctatattaatattgaatgtataagttcctattagcaaaatcatggaccagaatgatagtattctatccaatataagccctgaaatgttactgcatgtaattacattagagaaactattgcttaatatttcaatgcctttattttctaaactattatagtaagcacattctattaatttgactgtattagcataataaaagaaggatactattaggaaatgacaaaatgtgttgtgcggtattttgctaacaacatctaaaaaaaaatttgaagtagccgatatgataacattattgctcacatggggtaatattttgttgtatgtgttatatattagattataatcttctcctgatttttcagaggtaatattaataatccattctacatctttaagacatgataaattgccatttaaactgacactatttactaaaacatgatcttcctggttttgaaagttataatcagcttcgtctaggattatcaaaattactgaaatgttatgcttaaccatgtagctgatgagactactactattgattttttggaaacctacaactgctacctttttcatctgaacaaaaccctttctttttagtaataaattctagtaaacacctatagcaagaatttatcaaaatatttagtaaagtaaagatatatactaattaagcaccaaactcatcttctatttttttcacaatatcttctggaggattttctccccaaccggaatataatatttgcccatataaagccacatctatggagcctgacctacttttagcaagaaacatctctcttttgggtttatctaccaatacataatgccaagcagctcttccattatcttttccacgtacgagaaataggcaatctagtctactcttcttagtagattctgcaaagtttttgttgtttaatttgctttttcttaacaagttttttgaatcggaaaaaggcacttctttttcaggcttatcttgtaatatactagagaattttgctgatttattaggcaaagcattaggatttttatacttttcactaaaacttgcagcattaccttttctattagcagcaaactgcttagtaaattttgaatctttatttgtttcatcacccatctacttacacctaccttgataaaatcatgtattgtaaaataaccagtttataatactatatgatatattttatacatacaatataagttaacttaattatgcataattaacatgaataatatattaatcattactggacctacagcatcaggaaagtctaagatatctatgaaaatagcgcaagataataatggaattattgtgaattgtgattcaaagcaaatatatcgagaaatccctataattacagatcaaccgaatttgaatgatacttctgtagaacacaaattatatggatatgtatcagtaacacaacaatattctgtaggattatggatagaagatttaaaggatgaaatatcatccattatacaacaaaaaaagtttccagttataactggaggtagtggaatgtatatcaatagtctaatatatggcttatcgcaaattcctaagatagaagatagtgtaaggaatgaaacaagaaggctatttaaaactctagggaaaaaagagttttatgcattattaatagataaagatcctatagcaaaatgtttacataaaaacaattcacatcaattattaagagcatatgaagtcatagaacaaacaggaatttccatatttgtatggaaggaaaatgcacctcgtgaacctatatttaagaattttaagctttgtattcttatgccaccacgaagcgaaatatataaaaaaataaacgaacgttttattaatatgatcaatacatctgtaatagaagaaatagaaaatttgctttcactgaatatacctgcacattttcctgcaatgaaagcacacggtgtgccagaaataattcaatatttacaaaataaaatcagtattgatcaagcaatagaaatagctcaaaaaaatactaggaattatgctaaacgtcaatatacatggtttaagcatcaattccgaaatgcattattctatgaatctcaggatcagttgttagaatctataaaaaacagttatgtatattataactgaattcaaaactgttcgaattaaaacaccttaatccaataataatgtcatttcttgtcttgctctatttttttgtagcctttacaatctacatttagattttttatatttgtagtaaggtggtaaagatacttttcacactaggaaaatgttgaaattcaacgagattggggaagaacgatattagaacaaatattagaattctggtttagggaaaatcaagattatgtcttgcatggcaccagtatcgctttacaagatagtaatgaaggtaataaacaacaaccagatgctaattactaatttaccacagaaaacaaacacttaattattgaaaagtaggctagattgcccatttttctcgtacgtggaaaagataatggaagatctgcttggtggggcattatgtattaatagataaactcaaaagagagatgtttcttgctaaaagtagatcaggattcatagatgtggcttgatatgggcaaatattatatttcggttgggaagaaaaaccctccagaagatattgtaaaaaatagaatttgaaaatatctttaattcactatgaaaaatattttgcaacaaaatcataggaatcaaaaatgcccttctcaaacaatttataatctataagggtacatgttaatgtactatcaaataaaaataccaaaatatagaaaaattaaaaatatcagattttatattaatgtttatttctatagaaggtgcatattcccttgcaatgtaagaagatattatgcatatatagtgatgcattggataaaaaaatttattataagtgtattgtcttttctacttaattagtattgttaagttaaatgtttatttttcaggttgttatagttagtattgttactgcttaatagtatttaatttttaaaaaattgttaattagtaaaattcgattttttttttattactgtacagatttatgtaattcaccttccaattgatcaagttatatgtattgatttttagaaatatatgtttttaaataaccaacaatttcatatagtttctttattgatcatgtcattactcttctcatatttaatgatagattaattgcattaggatattaatctaactttttgtttttgtatattttagtaatttttcactgacattataattaaaaatataaaggaattaaaaagatatcttatttaacttttagtcaacggtttaaatttagtgaatatcacgttgaaaagtaaatacttattactaatattaaaaatgatgtaataaaagtgtgtatcatgaaagtacacctattcataatcatcagaatgagatgggttattttgatttttatataataaaaactatttccatttgactataggaggcatggacatcatgattgcatcagagttaccatttgtcagtaaaccaaatcttgtacctctatcgtaaattaaattaaattctacatatcttccacgcttaactaactgatactcgcgctcttctgcagtccatggtgtatgtagatttctctttacgataattgggtagatatctaataaaaacttacctactgcctgagtatattgaaagtcagcttcccaatttcctgaatttatattatcataaaatataccacctataccacgtggctccttcctatgatgtaaaaagaaatactcatcgcattgttgcttaaacttctgataatagctcttatcgtactggtcacacatttcacgtagattactatggaaaagttcttggtcttttttgttttcatatgtaggagtcaaatctataccacctccaaaccaatttttatctgatatacaaataaatctagtattcatatgtacagctggtacaaatggagagcacatatgcgcaacaacagaaattccgcttgcccaaaattttttgtcttttcctataaaagtattagataactcagaaggatttacagcatgagataattcatgattttgttccatatctccatatacttctgaaacatttattccggctttttcaaaaaccttaccatatatcactatagaatgccctcctccacctccaggtctttcccaatgcttatgatctacttgtggtataaaagatgaaaactgtttctctattgatataaactcagataagagctgattttgtaatgtcttaaaccagtcaactgctcttttttgttttgctttcataaacttaaaaaaaacactaaattgtgatacagtaaaagtatactcttataaaaaagaaaatattaaaaaaactaataagatattattcaacataaatataagtaatttataattctgtaaagaattatttatggaatgcaatattatgattaataaccaccttagtgttaaaattttattataaaattgataattatagtaaagttatataaaaatcttcctgtaatataaatacttaactgcaaaatgtagaaaaacttgtactctaacttttgctgtacacttaaataagatatattttggtgatactaggaaaagacaaaaaattttgggcaagcggaatttctattgttgcgcatatgtgctctccatttgtaccagctgtacatatgaatactagatttatttgtatatcagataaaaattggtttggaagtggtatagaatgaacatatattgaaaaacaccttttaatatgttattttatataaatcaatcgtgtttttttctgttagaaacttagttttgctcctatcaatccaatatagccagatttattagtatcagttctgtcaacatcgaaaaatacaatatcagcataaagaatcatattattacgtaatatcttctctatacctaatgcacatgctgataatgcatgttttgcataattttcaggagaagtcttaaggtttacctttttacctccatagaagtaactgaggccaacattaaacaaatcattttcaatctttaaacctaaatcataaaattcactatcaattattttataatgattagattgtacagaaatttcctttttaccagaattaccaagattaccatacgatcctataaaagtaatattattatattttagtgaaaaaccagcattataagatagtaaattattatattgaacctgttgctgctgattactagcaggtaacagatcatttacagcatgttcaacaactcctgatatagaataaccaataccagatgataactgattttgatatttgactcctacactaacaatatttttatacacatgggatttgatattgtttgcaatatcctgaatcttatcttttggaatatagcttaacccaagctttattcccttaatttgtggagaataataactaactactggaatagcagatccgtgataagcaatatatagacctggtgtgaataaaacagtatcttctttattgtgtccataggaaaaattagaattgtcagttcttagattaacatattgtaaccaacttccagtaacaccacctgaagctactgatatatctgaagatgaaagtttcattttttgtgaaacaggacttgtcaatcctacttgtaaacttccgatattagaagatttaataaagacatatgcttcttttgtattactatttatatctaatatagaatcttttgcattacctgagctgtctatactattactcattaggtttgtgcttaattttagaaaaggcccaacagaaaagtaatcattaatgtgatatgaatactctaaagtggaagttgcattaaaggacaaccttgaaaagtcattgctattaaaaccgtattgtagatttaacttaccacttaacgcaaagtcattagccgtagcttgatttataaataacattaaggaaaatatagcagatatatataatagttttctacacaccaaatctacctcacatgacagatattaattaagatattgaggtaaaataacattagttattaaaataatcaagatttttcataataaaaaattattcttactttaatatataatatattatattattttttatagatattgtacttagtaacagcatagcacagtgagtaagtaaataaacaaaatagaaaaatatttaaaactttacaattataatttttgatagattatatatctgtatttaataccatagtaccagttccatgtatggtaaacaattctaacaacaatacgtgtggtattctaccgtctattatgtgagctgatccataaccttcttttactactttaatgcaagtttgtaacttaggaatcatacctgcatttgctataccttgttctattagactttctgcattacttactgatatttcagataacaagttaccattaacatcagtaactccaggtacgttcgttaaaataatcaattttgcagcagcaagggcatttgctaatgcaccagctactaaatctgcatttacgttataagtaagatcattttcaccactacatacaggagctattactggaataaaatcagattcttccataaaaaataataagtctgtattcacctcatgaggttctccaacaaaacccatgtctagtattttttcaacattatttgactgattttccttataagtataacaaactttttttgcttctattaaattagcatctttaccacataatccaatagcattacctccagctttgtttattagttgtgtaatatctttattgactaatccacataataccatttctacgatttccaaagtttcagcatcagtaactcttaatccattaacaaatgtacttttcttatttatcttctctagaaattcgttgattttgctgccgccaccgtgcacaactattggattaatacctaattgttttaacaatacaatatcgtgagcaaaattttctgctaattttctatccttcatagcagcaccaccatatttaatgataaatgtctcaccagaaaactgctgtatatacggtaaggattctgataaaactcttgctgcgttaaaccaatcagcatttccaccaaattgctcaatgtttgatacaacatcttctttattattattttttaatacattgtgcaatttcataaatcaactcctctattccttgtttacattgactactagtactgatgattggatacataataaaatccaaattaagatttttaatataatttacgttaacatcaagcatttctttttttattttatcaatttttgttaatactaattggtaatgtatttggtgtaactcaagccaattgataaaatctaagtctatttccttaaatccaactttagcatctataagtaatataacttttaataggtttctactatttagtagataatattccataagacataaataattattgatagtagttttatctgctttagaatatccgtaacctggcaaatctactaataccataaaatctttgttaataagataaaaattaatttgttttgtacatcctggtttagaagatgttttagcattttttttattatttgttattgcattaattagactagatttgcctacatttgatctaccagcaattgcaatttctggtatagaaaaatctggtaaagactttatgtgagtagctcctatcataaattcacactttgacattatagtttttagcttcatgcagttaaatgcttaattataaaaatattaaaatatataaaaaactatgcttcaatactatcacatataaaaatttaaagaaaaaaattttgcaattaatattacaaatgatattatctagcaaaaagtagataaagattattaattgagtggtgacaaagctatgagctttgataatagtttagaagagttgtctcaaaaattctacaaactaaaaagtatgttagaagatccaagtcaattgagtgtggattcctttgttgctgcttcaaaagaatattcagaattattgcctgtgatatcagtgatagaccaatataatatcttacaaaaagatatagcaggcttagaagaactgataaataatccagaaactgatcatgaattaaaaagtctagctaaagaagaattctatgaacggcaaaaacaattacctaaagttaagcataaattaaaattatccttacttcccaaggataaagatgatgcacgtaatgctattttagaaattagagcaggtacaggtggagaagaagctgcattatttgtgactgatttatatagaatgtatacaaaatatgctgaacaaaagaattggaaatttgaacagattaactcatcttcaaccggtataggcggacataaggaaatatcattatgtataagcggatctaatgtatttgcaaggttaaaatttgaatctggagtgcatagagtacaaagggtaccggaaactgaagcttctggaagacttcatacttcagctgctacagtagcagttttaccagaaattgaagaagtagatttaaagatagatgaaaaagatttaagaatagatgtatatcgttcaagcggtccaggaggacaatctgtgaatactactgatagtgctgtacgtattacgcatataccaagcggaattgtcgttatacagcaagatgagaaatctcaacataaaaataaaagtaaagctcttaaggtattaagagcaaggctttataacctagaaaaacaaaaaagagatgcagaaatttcacaaatgagaaaaagtcagataggatcaggagaccgttctgagcgtataagaacttacaattttcctcaatctagaattacagatcataggataaatcttacattatatagattagatgatattatgaaagaaggaaatttggatgagtttattgaagcattaatagccgaagatgaagcaaataaattaaagaacctgcatatttgatcaaaaaaacttttacaaaccagattagattactttttaaagaattactgtagggttcatcaatggcttaatattagcaattgtgtcttttgtagcacttatgttaaggaaaacacattgatattcatttatatatcattataatataagatttatcctatgatctgtaattctagattgagggttgtaagttgatgattcctttagtatatgtaataaaaaacagttattatgtaagttattaactactattaaaatatatgcttaaaacttgccatatattaatgtttgttgtgtttacaggacaatatatctcaaatttgtactgctgttctttgatattacattaagttcactttactcttgccttttctcataaaaaataaaactttttctcaaaataagtttttgcaaaatattattatccgtttatattaagacactgtttttattattatacattctttattttgacggataagatttgtggcaaattgtcatatccaatagagtcaaaaagtttattcttaatagaatcatttttgataaattcttgttatagatgtgtactagaatttattactaaaaaaaggattttattcagatgaaaaaggtagcagttgtcagatttccagaaaatcaatagtaatagtctaatcatctatatggttaagcataacattttagtaatattgattaatcctagacgaagccgagtataactcttaaaaaccaggaagatcatattttagtaaatagtgtcagttaaaatggcaatttgtcatgtcttaaagatgtagaatggatcattatattaacttctaataattttacatattttttgctagataatattattagtattatatgaatttcatatctaaaaattatttgataacttgcaaagcttgtttgaaaatttagagtttcgtatagcaaatacatggatattgtaggaatgtgaatttttagaagtatagtatatggtattaaagcatgaatattaatacataatcacagaaaaattcagaattatagagattgtcaaaatataaaataaatattgaatatattacatgcataataacatgagaatgttattttacctcaatatcttaattaatatatgtcatgaactatactatgtaatatttaaatatttcttttttggattttatatactacaaaatgtacttttgataaataaaaattcactaataatgcttaagtaaatagcactataaatataaatgattaaacagaatatctaataataataccaaaaatattttatgaaaagataaggatggataatcacatataaagaataatctagtgtaaaaacacattaaataaataacttacgaatctgtaaaacattgataaaaagtttattaaatgcaagtttactctataaaggtaaattatcatgtttacgcataatcttatgtactttctttttctctaaaaattgtaaagatttaaatagatgttctcttgtacgtgacggtactataatatcatcaatataccctctagaagctgctacataagggtttactattgtagtacggtattcatcaataatgtgttgtattttatctttatctttttcatttctaaagattatttcaactgctccctcagcacccataactgcaatttcagcatcttgccaggcataattaacatcaccacacaggtgtttagaattcattacgatatatgctcctccataagctttacgtactattacactaatttttgggacagtagcttctgcatatgcatacagtaattttgcaccatgtgctatgataccagaatgttcttggttgacccctggcataaatcctggaacatcaataaaagtaataacaggtatattaaaagcatcacaaaagcgtataaatcttgctccctttcttgaagcatcaatatctaaacatccagccaaatgtaaaggctgatttgctactaaccctacattataaccccctattttgccaaatcctataataatattacgtgcgaaatctggttttatttcataaaatagcctttcatcacatactttttccaataactcatacatattatatggagtagtactatttttaggtactaatgtatttaaagataaatcttccatatttataaaatttgaagctgactgagatcctattgattccatattattagatggaataaaattcatgaatctacgcacttgcaataatgcttcaatttcattatgaaatactaagtctgcaataccagttttactagcatgtacttttgctccaccaagatcttcctgagtaacttcttcatatgtaactttttttattacatctggtcctgttacaaacatataagaagtattacgtaccataaaaataaaatcagttaatgcaggagaataaactgctccacctgcacaaggtcccataattaaagatatttgtgggactactccagacaagttaacattacgttgaaaaatttctccataaccggataatgaatccacaccttcttgtattcttgctcctcctgaatcattaataccaattataggaattcctaatgaagcagctttatccataatattgcagatttttttagcatttgattcactgagagatcctccaaaaacagtaaaatcttgagaataaatacatacttttctaccattgatagtaccatatcctacaactacaccatctcctggtatcttagacttatccatagaaaaatttacacatctatgctctacaaatgctccatattcttcaaaagaattatcatctagtaagacagttagtctttctcttgctgttaacttacctttaagatgctgcttttctattctagacaatccaccaccattatatgattttgattgcctgttatttaaatcctgtaaccctgcaaaattcataatatccaaaaagaaatagaagtattagaatactcttatcacatttcacaatttatatcaaacatgtaaactttataattatttttctttattatatagatgaaattctatatacacaatataacagaaagtgattgattataataatctgacatttcctaatcctgtagcacttacttcggttaatgtaccagcacaatatatagcatcaactattttaccatcttcatcacagaaattgaaacgtgaacggacagtgcttgcattaacttgaggtataaaagttgcattggtttttacgtcacaaaataattgtttaacactacggccattagttgctcctccaccgatataattttctttattgaaaaaaaaacatggcgtgtgttctgtacgctgcgtaaaagatttaaattcatttttactgactgatagagctacaaacacttcttcattgttgttattgagaccagacaatataataatttcattaagacaattgttacttctgacaacacaatatttagtaaacaaagctccatataaagtaggatcatagtttggacttgcacttggattagccgaagtatctcctattatactttttaagactgggtcgttagtaacaaatgtatcattttcagatctatatgagtctgcactagataaaaacatttgggaatttttatctaataaaagaattagtaattgcataacctataacactaacattaaccattattctataataatacataaaaaaaactaaagaattctattcttttttttataattttataaaattactaacttattacattaattaacttaaaaacatatcagtttttgattacattttacagatttttatttatcgaaagtacattttgtactatataaaacctgaaaaagaaatatttaaaactacatagtataattatgcatgtaatatattcaatttttactgatcactattacatgattgaaattacaatttaatgtgtaaatcaacattatatgataataataagtagaacatattacagattactttatacttgttacattaattcatttaaaaacatatcagtttttgattatattttacagttttactgcttactattacatgattgaaactataacttaatgtataaatcaatattatattgtaataataagtagaacatattacagattactttatacttgttacattaattcatttaaaaacatatcagtttttgattatattttacagttttactgcttactattacatgattgaaactataacttaatgtataaatcaatattatattgtaataataagcagaacatattacagactactgagaattgaagactgagtagttactgattcagaagtaacactacttagagataatgttgggatatttccattatttctcggtaaagtctctgctactgacttgctagtatgactttttaatacaatactagattcaccatttctttgacgtcgtgataatacagaataatgttcttgtacacgagaatcacctatccgcgttacataacactctcgttgatgagaatcatttatttttacatgatacattgagtgatcagacctgtcttttggtattacataatgctgtatagattgttcagaaacacttattggcaaaacatagtactcactctcaacattattgatatctacaacataggatgagtccacattattgtttcgtactttacaatgcatttgttgtgtaacattacttgtcgatgcaacattatgttctaactgcatagaattatcagataacgaattaccatgctcttcactatgggtaacagtattttgcctagaagagatatttaatgatgatgataattgattattaaacgttttattttgtacataatataaagtattgtgtttatcaaaaaatttataaaaatacatgtcacgggagtgatcttcagtaggaatatttgatacaacacgttgtatgtaatgatcagtaaatgttacagtaaacgcttctgtaaattttaaattaacaaatctacgatatccttgaatatctctacgaaatgcatgaccataatcatatataacatgtccaatacaagatacagaactttttgaaaattgaaaacctttaagtatatcattaaagcttaaattaggactaaatggaataattaaaaatgataattcatttctatgcataccatagaaaaaaacatagttatatacacctaatggattttcaacaagatgaaaatcatcaaatttaacaccaattaactcatctaatccatcaccactatttgtagaattatgttctaaaacacgattcaaatcatcattacatgtatagtaagtattaagtgatttattaaatttacaatggtcactgacacataaacagtattctcctgtttttaactttagtaacgtgagactcataatattttttttatttattaatagatattaataatattatataattactaaataatatcaataattattaattgtttattaataaaagtagaataactaatatttattttaataatttttagcattagtaaaaataatagatattaaaatattgttttatcctaaattgaacttagcatacattgatctatcttataactgacagtatggacaaaaaaaagtgcttctaccattttgctttattaccaaaatagaactattacacttataacattgttgtcttgtcctgttatataccaaaaaatgattttgaaatgttcctcttattccaaatggtgatgtgtaatcttttatacttgatccaccattttctattgaatacaacaatatatttttaactccatcaataatattattgcactctattattgataaatcttttacaaacctattaggtgctattcctgctaagaaaagactttctgtagaatatatattacctataccagtaacaaacttattattcattagcaaggattttatagtacaccttttgttagaagtgttatataaataattagtattgaattcatcagatagtgcatcaacaccaaaattcttaaaaaattctatatattgactataagttaataatatcactattccaaatcttcttggatcattaaaaataagcaaattgttattgctgaaatgaaaaattacatgattatgctttttttgttttatgtagctttcactataaatcaaattgccactcatacctaaatgtataacaaggtagtactgattactaaggactaaaacaatgtacttaccttttcgaagtacttgaaatacagaactgtttacagcaatatcacataggttttgcgtgactggaacacgtaagtcatacctattaacttctatatctaatatagtcttacctagaatctgactagataatgctctacaaactatttctacttcaggtagttctggcattttttacttgacgctgtttatttttcctacgtagtaaattagcctttagtgcgttagataatgctttatttttatcttcatttttaattttttttgacttatccataataaaaaaataaaataaaacctaattaagccgttatagcttagtggcaaagcacatcattggtaatgatgagacctaagttcgattcttggtaacggcactcacttattagcatatatattttttacaaaattgcaaacactataatatagagtgtactttctccatttgtataatcctacagttcttcaattataacaatactgataattaacaaaaagaacccaattattttataaagtaaatttttatctttttatatatttgtattattgcttctctcagaatcacgataacaacactctttatcacaaaaatggtagattatttactacataactacttaaaaaaatatacataaaaatcttataataagtgattatggaataactattgaagaattaaaaaatattttttataccataaaatctatcaaatcagaacctaacagtaaaagttataaatcccattatgatattgcctcttttaataacatttagttaatacataaaccaataatactatatcaaaatttactttactgttgctggtattataattcgatacatcattatataattactttacaaaaatgttgaaatataaaacaattctagtttttataagatttttttatgtcacataatgtaataactcgatttgccccttcaccaactggacatttacatttaggaggagcaagaacagctctattcaactggctatatgctaaacataacaatggaaaatttttattacgcattgaagatactgataaaaaaagatcatctaaagaacttatcgactctattattaatgcaatgtcttggttaaaaattccttatgatggggaaatagtattacaatcaaaaaatatatctagacatattgaaattgcaaatcaactaatattaaacaataaagcatattactgttattgttctgaggaagaaataaataaagaaaaagaagaatttagtaaaaagggtttatattataaacacaattgtatatggaaaaacaaaaattttacaattgataatcttactagagtcattagattaagaagccctactgaaggtgtcacatcatttgacgataaagtatatggtaatatcacagtaagtaatacacaattagatgatatggttttattgcgttctgataacactcctacatatctcctatccgtagttgtagatgaccatgacatgaatattactcatattattagaggaacagaccatttaacaaatacagcacgtcaattattaatatataatgcattagaatggaatcctcctaaatttgctcatattccattgatacatgatgaagatggtaataaattatctaaaagacatcaagcaattggcatacatgaatataaaaatttaggtatattaccagaagcaatatccaattacttgttaagaatgggatggagtcatgaagatgatgagattattagtatggatcaagcaataaagtggttttctataaagaatatcggacaatctccggcaagattagataataaaaaactggaatttttaaacaatcactatatcagtcttactgaagatgaagtgattctgaatatgattattccaattatagaaaaaaagataggatatatgctaaatgaagtaaaaaaaggatatttattaaaaggattatatgaactaaagaaaaggacaaaaaatctagtaaatttagcaaacgaatctttgttttacgttgaagatgtaccaatctctattgatcaagaagctagtgctattataaaagattataagcacgtgttttctatattatataataatttatcaagaatttcagaaaaagaatggaataacagcatactaacatcaacaataaaaaacatttcacaaaacttagatataaagattagtaacatctatcattgtctgcgtgcatctattgttggaagaatgaatgctccaagtattattgaaattatgattaatcttcaacaagaagaatgtctaaaacgtataaagtatgcacaaaatatagaataagcttcctcattataatcttgtacaaaatgctactttaaattattgtctagaataacttatttataaaaataatacataacttacataaaatacaatttttgcatagcacataagtatgctattaaaagattacatgttgtaaaaaattaatatagtattttattaaatcttctaatatcggaagtttacaagtaggattgacaagtcctgtttcacaaaaaatgaaactttcatcttcagatatatcagtagcttcggtggtgttactggaagttggttgtaatatgttaatctaagaactaacaattctaatttttcctatggacgcaataaagaagatttcataccaggtctatatattgcttatcacggatctgctattccagtaattagttattattctccacaaatcaaggaaataaagcttggattgagttatattccaaagataagattcagaatattgcaaatgatatcaaatcccatatgtataaaaatattgttagtgtaggagtcaaatatcaaaatcagttatcatctggtattgattattctatatcaggagttgttgaacatgctgtaaatgatctgttacctaccagtagtcagcagcaacaggttcaatataataattgaactataaaaaaagttctaatgacgctaattacacaagtttcaaaaatctataatacaagaaaattataaacgcataaaaatgaatgtatgtatagaaataataattaataaatattaataaataaaaaaattattaacattttatataaaatatattaatttactttaaatgtattaatatatattaaaaatcttatgaatctaacattattaaaattgaaaacaggaaaatatattttatgtgatatttatgaatttcatgaatatgatttagacagtgatttcactaacgatcactatacactagatcattttatcgggatgaaatttgaagattgttatttcattgaaaatacactgtccaagtattattacgcttttttttatggtatgcataaaaataatttattatttttggctatacgaattaatagaaatataagtaataatcagctgcttaaaagttttcaattttcagaacgttccatttgttgctttggtattgcaactcacattcatgacttagatattaaaaaaagtatgcatcaatattaccattttatacgtcacgaaaaccctactattcaatttacaagattatttactgtagtagcagtttctcattatataaagtgtagcatgttacaatccatttatgatgacaataatcagaatagtacttatagtatatgcgtttataatttttttgataaagaaggtaagatatattatcaacaatacgaacatcatactgcatatccattatatattttgttaaactttgaaaaaaatataattatctgtgataatgcactgggtggtttaagaagatataaaaattacacatgtcacaatgtaaaatatggaggacagtgtaaaggaaacataggatattttcttgaaaaatcaacgaatacttttatgtgtgtagagcatgatgatatattagagagtaatcaattatcatattccactaaagtagctacttctagtcaacaggaataccatcctctattaccatctacaagtgaagttgaagtaccacaaattaaccatgatggattagaagatgacatttcaccaagaaataacgaaagcgctccagggttatttgttcacaatactgatcttgaaccattaaccgttaaatttccattcagataggtatgtatattaatattccgtttattgttacaatacagtactataattagtattactataaaaactataattaataatattaaagttattgctgtgccgcattgatcttgatattactgtatttaagttatgtaataataagcagtaaaattgtacaatagaatatgaaaatcatgatatatagcaataaccataattttttaatgtataaaaaattcagagtgctttttgcaattgttgggataaagtatcagttattaaataatattgttatgtatgatggacatagatgttttattggttatatgaaatctaaaaacaatattaattttttaatagattagatagtaaaatagcaaatcagttttataaatatataattttgaatcccaatcagcatacccttactttattataaaagtaaagagacagtaaagttacagcaatagtatactatttaaagagaataatgcttcttaattaaagaacagtttataatataaaaaataactaaactaagattactactataaatgaatgtttttatttaagtatttatctggtaataagtataagtaatatataattatatattaattttttaagtaaaaattaaacaatagaaatataaagatttattaaaatattataaagataagtgcctatattaatataataatatacatttaaaatgtaagatagcagctgtatatactatactgataataaactacaaataattgatactagttgcaatacttgcaatactactgacaattagtatataattactagtgtattttcatgtgtttaatggttataaattatgttagcaaaattaccaaaagtgtcaaaaagtaaatcacaggagcaaaatgaaccgtggcaacaaaatgaaacaccggaacaaataaaacaacgagtccagaatatcatatcaagtccaggtgtagataatgatgatgcagaattaatatgcaatatgatagataagaatcacgtacaagatctactgtatttacgttattatgtacaaaatttaaaaaacgatccaagaatgaaattaaaatctataaggtgtgtgggtaatactaattctaacactggagaacttaccttatatattggagataggaagaaaataccagtaataccacatggaacatctatttttagagtaactgttaatatattaaataatgcacttaacgacaacccatttcttaaggaacttaatgtaatatcaaacaacaacgattcttcatgttttgatttatattgtcttgtactcgcaacaaacatgaccaattttaaatgttctacccaaagtaaaggtaataatgactttctggagtttagtgaattaatgcttgtccatccacagtctggaaaagacggtaaacatttaactccacatttcgaggagaaatatttagcaatgcttggatttcatgtatgtttagagcctattgttcttaaaacagacgaacaagaagcatctgaatgtgatgaaggggcttctcctactaaatctccttatgcatctaatgacagcattgcttctagttatagtacatcttcttctttagaaacagtaggtatgtcagaggaagaagatacagatttaaatccattaactccttcaccacatgtcttgggaccatcactttatgaacctatgttctttccagatacaccaggaacacctaaaacatctagaagaagtaagtaaaccataccagtaattacttaacataaagtatagaatatgtgtatttaataatactattttactcatcaatactctgtaaattttactattataaaaagcttactacatgcaaaaaagtacatgttaaatctgaatcagaagaattagagtattagctataataaatacagtatgtgatatttatttgatatatgtattttaagctaatacaatcttctgtaggtacaccaaaaaagtactagtaatctattgtaaagtacaagttaaagaagtaatacatacttaaactaaaaggtttacattttttaccacatatctttgctaaaaaataaaaacatatctctagatatagtatttctagcttactttattaagcacttgtaatttggatcacatgtagatttttcttgcaaaaaataaaaactacattatacaagctaggtagaaatacattatttacaatacaggaatattagtgtttaagcttttcatacactgtattttctacagctgccctagctccagaacttactaatttatctttatatgagatgaaaaatgatttattatgcagacatttgaagaggacacttgaattttaatcttatcaaaataaatcaagcatcatgtataggtaatatactactcaacagtttctattacaagtacatatttcaaaaacactacttcatggaaattagcatttgaacttacatgctcaatatttatctaaataaacgttgcacgccatccaggctagtaacaaatgaattcatatttagcaagattaataaaaagaacaaagttactttgagaaaaaaaaaagcagcctaataagaacttaatgtctacatttgagaaaaagcagcttaataagaacttagcgtgtacattttaggaaaaaagcatcttaatatgaacttaatatgtacatcaagtgctcttttacatttattagtagataagataaagttacaatattttttactaataaaattatataatcctgcacaaaaaaatcaatgctgttgatcaattcttcaaacatagagaagtcacatttactaagttaaatacagaacttatactatgccgtgaattattagatgaatacgaaacattaactgaaatactataaaatgactacgtttattacttctgaaaaagaggaaagaaaatgttgtttcccacgttataaaccaacaaaaaatgttaaaccataaagtacatcataagaaagcttattaagtgcaaatgctaaatgcagatgaagctcaactataaaatattaatgtaccaatatcagaagataatcagtattattacttactggccttctcagaagataagttagtgttttacttcttcatctttagtatgtgtagaaggtataaatgtccaacattataggcaaaaaatattgtagtatttcaataccaaaattaatatttattaagatataatttaatattaaaaattattaaaaatatttattgtaatatagttaattttatttattatttaaataaaataaattaattaaatattatgcaaagtttagatattaaaaaatttgttaatggacatttatgcagaaaagcagatgccctctcttttatttatcaaaaatgttactgtataggtcataccccagaagacagtgatacattaacaatacatctttccaaaacccataaaagcaaaaaaaaagtggtgccatctaagaattccttatttgtattaaatgttgaatatcctgttgcgatgatgaaacaattgcgacatatgaattttctaacattatcaaaagatgaaatgggaaaaaatgttatagatgcaaaactttatatttttgtcaaacaatgtaatcttaaaaaattcatgaaagaagtattaaataacaataaaccaggatctactgtaacaccatctgaatatggtagcgttgtctatacagtattatgtaataataagctttttgaagattttaatgaacataatgctttaagcacaatttcaaagatggcattaacaaatacacgagaatttcctgcttttaagtttatacctaaagttggtatcgcccggaaattactacatgctataggatgtgtttcacaaaatgatgaacctttaacctcaacaacaattggcactcaagaagaagaatcagtacctacattagattgtctatcaacagaaccaatttatgagcctttacaaacacataataaataatatatcatacacattttataatatattaaatgtacatataccattctttaattttccttaaataatagtattattacagatttattataaaatttattataaaaacgtgttttttaacggtaaatcatatgcttaattttagtgaagaagaccatcgacagtacaacaatgtattatgcagaaacctgaagtctatgaatgttactgtactaaatggttattgtgtcggtactacacaaccaaataataagttggaagtatctactgaagctgatgaaataaaccctattgtaccttcacaaggaggtccatctttgtttaagctcttcgttcagatcccaaaagattccgtattaggtgatccaatactcacggagagtgttgatttctcacaagaaaatattaccaaacttactgttgaagcagaggtatttgctatagtacgttcaaatgatacaaaacattttgtgcatatattagacaaaaccaatgaagaaaaacgcaaacaagataagaaaaagagtaagaaatataaagctctggattttgcatctattgctaattcctgtaatcctgtacttgtaaaaccaaaagcatatgctaatccagaagtcaagtttgacttaaaatatgcattgttaactactggtggactaaattatgtaacattctctccaagcacaccaagaacagaagaaagattaaaaatattatcaacatcagcaccttcaatattacaacaacaacctacatcaagactatcagaaagtgatgtagaaggatcagcaggctgcttttctttcttaagatgtacacgttaaattcctaataggatgcttttttttagatgtatacattaaattcctaataggatgcttttttcttagatgtgcacattaaattcctaataggatgcttttttcttagatgtgcacattaaattcctaataggatgcttttttcttagatgcacacatttaaattcctattagtttttttctttcttaagatatgtacattaaactccactaagctgcttttcttagatgtacatgttaaatttttatttagtaaaaaaataatatccaattataaatagaaatttaataatatataatcctctttattttcttataaaaattgataaagtgcattgtataagaaatttaaatgacaaaatggaaaattaagtataccaggagtgatgacactactattctaactaaaagtgaatataacttagcattatatattcaacaatcaaaaatctttcaccaatacttaaaagacagctaaacaataggaaaaaatgcaaagctttaacagtaaagatcaacttgaaaattttattataaaacacaaaacaaaagaaagcaacaattataagtcttatgcattttgtatcgttaataggaatactatatttgaattaagaaaagaatttatagagatttgaaaatttagatatttattttacctacaaatataattgaaatctatgaatccaccttatcaaaacttaatctaagaacaattattagtacttaacaatcaataatattagaatatgttaacccataaaatacataaaattataaaaaacaaacaattaaaaaaatcactaataaaattaattatcatataacaaaagattgtttttttatatcttataataaaaaataatacctttatatcatataattattatgatttttcataaagattaaatattgtagaatgttatgttaggtatattaggaaataatcttgaagaacaaacttggtataatgagaaattatgtgcagatgtatcaaagatatcaaaaacagaacctcttatatgttatcgaagttattgcataggcaataccgaagatggtgatactaaacaactacaaatttttgttaatgatagttataaaaaaaatgtacataagtgtttcccaagtgggaagtccatgtttatattaaaaactttattaccaaaacatctaataaagcatcatagcaaaatacgtcaggcagttatgaaatatacacaggattatgatcctagtttctgtcatatgcacatatatcttttggtaaatgaagataagctcaatatattttaccatgatgtacataataggttattaaataaagaacgactgatgatacctattgaagatcttactcaatatggcacaatggaattaatttatataccatatataaatcgaaaggaaaaaaagtttgatatggagtacgctctacaaaatgtcgcaggattaaatgcacaattcatatatgatcaacaagaaaagaaatcctctgaacatgatgaaacaaatgcaggtgctgtcagtagttttttttccaatttgagaataactattactaaaaaagcatctactgatgaggataaagaacctttagtagcgaatacaagaatgtagcatagaaagtataaaaatttccttgtgatacactattttttaatctaagctagctgcatatcaaataaaattaaaaagataaatgggaaaaaattgctaacacacttagcattttttcccatttatctattgttttgatattttcaggagttgttgaacatgctataaatgatctattacctgctagtagtcagcagcaataggttcaatataataatttactatcttatagtgctggtttttcactaaaatataataataatattgcttttataggatcgtatagcaatcttggtaattttggtaaaaaggaaatttctgtacaatctaatcactataaaataattgatagtgaattttatgatttaggtttaaagaattattcaagtagaatcatagataaaaattaacaagaaagtatatcacaaaatttttagatttctataacctaaaaaacataaattataacaatgtttttaaacagcaaaaaacaccattccaaacttacaaaaacataatacctatgtttgtttatactaagaaacttaattttagtttttttcatcaagaagaaaactagtatatatgcaagaactagaaatatactcgaataaaaatataattaatctgatactacagcttcttttttttgtatttccatcaatatatcctttaccttatcaggagttaatttctcataataatcatcattgatctgcataacaggagcattaacacaagcccctaaacactctacttctttcaaagtgaataaattatcactcgttgtttctccaacacatatattaagcaattccttacacgattttaaaatatcatcactaccacacaaccaacaaggagttgtcctacacacttgtattaaatatttaccagtaggagataaattatacatagaataaaattttgctacctcatatacatgtattagccgcatacccaaaaaatctgctatataattcatagcagacaatggaataaatccaccacactgcttctgagcaatatgcaataaatccattacagcactcgattttctatcatgaggatacttactaattgtatcatttgcttgttttaagttatccttattaaatttaaatgtttcagtataatgttcattactatttttctgtatattagacattactcattacctatctatttctccaaatactatatctaaagacccaattatggctgttaaatcagctaacatatgaccttttgccatcatatctatagcttgcaaatgagcaaatccaggagctctaatcctacacctatatggtttatttgttccatcagatactatgtatacaccaaattcaccttttggagcttcaacagccatataagtttctcctattggaacactataaccctctgaatataatttaaaatgatgtattaacgcttccatagattctttcatttccgacctttttggtggagcaatttttctatcatctgtttttattggaccatttggaagacgattcaagcattgttcaagcaacttaattgattgcctaatctctgccatccttactagataacgatcataacaatctcctttttttccaataggaatttcaaattctaaatcttcatatatttcataaggttgacttttacgtaaatcccaaggaataccacaagcccttaacattggaccagaaaaaccccaatctaatgcctgttcttttgatacaataccaatatcaacattacgttgtttccaaatcctattttcagttaacaactcatctacatcatctataaacttagggaaagttttaataaatttaaatatatcatcaatcaaatcatctggaacatcagctgctacacctccaggacgaatataagcagaatgaaacctcgcacctgatgctctttcataaaaacctaaaatcttctctctttcttcaaacatccatagtaaaggtgtcatagcacctatatctagcgcttggcttgatatatttaacaaatgattcaatattctagttaactcacaaaaaataacacgtaaatatttagctctaattggtatttcacattttaataacttctccacacataaagaataagcatgctcttgacacattggagatacataatcaagacggtcaaaatatggtaaagcttgtaaatatgttttatattctattaatttttctgttcctctatgcaataacccaatatgtggatctatcctttctataacttcaccacccatttctaaaaccaaacgcattacaccatgagctgcgggatgttgaggaccaaaatttaaagtcattggtgtaattttgactcgatcagacattaccaaattaccaagaatataactataaattatgtaagtacatatatcacatgtcaagaacaagcttctatatagcataaagagaaattcttatttaacagatataaacacgacacttataacaaaatgtattaataaaaaactaccttagtatgaaaaaataaatgaagtaaacacattaaaatatcatcttccaataaagtctatttatgcatagcatgtgatacatattgcttattattactaggcaatgaatctgtatatactagaatactcgaaactaatactacccatagcaaagatataggtaaaaatactttccatcctaaccccattagctgatcataacggtacctagggatagtagcacgaatccatataaagcaaaataacaatgctaccactttcaatacaaaccatacaatcccaggaattatatataagaagccaatatttaaaggtggataccacccaccaaagaaaaatattactgccattgcattaattaatatcatatttgcatattctcctaaaaaaaacaatgcaaatggcatagatgagtattcaacattatatccagatactaactctgattctgcttctggtagatcgaaaggatgtctattagtctcagctaaagctgaaataaaaaaaatacatgccattggcaataataataaatctatccagtaaggcatattatgccgtgctacaactatctcacctaattttaatgatccagttgctaataacactgtaactatagttaaacctatagatacttcatatgatatcatttgtgatgcagacctaattgcacctaaaaaagcataatttgagttacttgaccatccagctattataattccataaactccaagagaagaaatagctaaaatatatagtacaccaatatttatatttgcaatagcattaggtattatcacttcatatccatcattaacaattacatcagctccaaatggaatgacagcccaccctaacaaagctaaagtaaaagtaataatcggagcaatcaaaaaacatattttatttgatttaaaaggaataatatgttccttaataataagctttacagcgtcagcaaaaggttgcaataaaccaaatggtccaacaacattaggaccttgcctcaactgtattgccgcaataaccttacgctccatgtacactaaataagcaacagatatcataaccgatattatcactgcaattatttttataaataatgcagctccactacctatgtaacttaaaaaatccaaaaaaatattataataactcatactcacctaatctttatttgcaaaagcttttacacaatttgccattataatagatgcacgactaattggatttgccatataaaaattaaaatctttattaataaatacactatccctttctaaaatcatacttccatcaattgaagcccatttattagaaattaagcttccaatattttcttcacgaaattgctttcctaatgttgacaatttatttctaatgcaatttaaactttcgtattgcatatccatttttaaatattttgataattctttaataattaaccaatcttctcttgcaagaccaggaggagaaacagcaatatttgttctctgtactctaccttcagtattaacataagtcgcatttttttcagtatatgctgcaccaggtaatatcacatctgcaacctgtgctcccctatctccatgatgtccttgatatataatgaaagaagacttagaacgagaaatttctacttcatctgcacctaacaaatataaaacctctatttcactagaacctataccattaattatatcagacattatattagtgttagaactaggaacaaacccaatatctaaagcacctactctagcagaagctttatgcaaaacattaaatccattccaatcatctcttaacataccaaattttgctgcaattttagtagctaatacaaatatagaatgaccattatcaccaaccaaagcatcttgtcctattattaacataggattttttgcatattttaacagttcagaaaaaggtattttttcatgtagaatatcatctaataccaaacaactattccctaaatcttctactttataattaaaattatcatagacacctaaattagcaatcttaaatcctcctcgtaaataccttttacgcaatcttgcattaattataggcgcttcaaaccttatatttgtgttgattaataaacacaaatccgcattttctatattagatataccagtattaaacaaatataaagctctgctattagtaggtactactgatccatcttgcctacattctatattagaactccctaacccatgcattagttcctttaatagcaacatagattcacaatctgctaaatctccagcaattgccgcaattttatctccagaaacattactaatccttttagcaattacattaaatgcttcttcccatgttgcaggtaataactgcccattctttctcacatatggtttatccaacctctgcaattttaaaccatcatacgaaaaacgtgttttatctgatatccattcttcatttatactttcattcaatctaggcaatatcctcattacctctagaccacgtgtatcaaccctaatattactacatacagcatctaatacatctattgtttcacaatgacgtaattcccaagatctagctttaaatgcataaggttttgaagttaatgcaccaactggacaaagatctattatattaccagataattctgaagtaatacatttagaaatatacgtatctatctccatattttcaccacggcccattgtacctaattcatagctaccagcaacatctgataaaaatctaacacatctagtacaatgtatacatctagtcattgtattttctatcagtggaccaaaattcttcttctttacagctcgtttctcttccttatatctgcttttacctctaccatataacatggtttggtcttgtaaatcacattctccaccttgatcacaaattggacaatctaaaggatgattaattaataaaaattccagtaccccttccctagctttttttattttgtcagtattagtctttactaccataccctctgcaacaggcattgcacaagaagctacaggtttaggtggaccaccaacaacttccactagacacatcctgcaattacctgctatagcaagcctttcatgataacaaaacctaggtatctgtactccagcaacttcacaagcctgcagtacagtcattccatcttcgacttctatttctaaagaatctataactagtttaaccacgcactatccttatatactagcccattctataggattacctgtagtatcttgtactaaatcaccattatcatattgacctgcaataaaaattttacctgcttctctattaatatatttaactggctttacagatttaccattatacattttttgagctgtaccttttttacgttgcaatggattattcttacttgctgtttttgcaactttagctcctttcttagccataatacccccatagccataaaatcatgaagtaatagcacattttaccatttaggtttttaacgtcaataaattatatagacaaaactcttaatgatttgctatttttactttaattctttatctttacaaaaatatctttaatggaggtaatttattaataaaacatattcaacaatatttactacttgttattacgcatcaatattttgtacatttaaagcattattattaataaagtcacgtcttggttctacaaaatcacccataagcactgaaaatattgaatcagcagcttcacaatcagctattttaatttttaggagtgtccttgtttcaggatttaatgtggtatcccacaattgatctgcattcatttcacctaaacctttaaacctctgtaaggtcatatcctttttaccaaattcaataatattatctactaaagaagtaggtgaacttatttttatattattgtctttagtagataaaataggcatattataaaaaatatcctcaattccatcacacatagcaataacatgcttaatatcttctgaattcatcattgcgctattaatataatatttatcaaccagcccatgagataatctaaaaatacttatctcatcttctttaggtatttcaacactccattcatattcacaaaaaactttatttaaatgatcagatattgcaccagcagaatcaaaattatgctttctaaagaaaataatcaatgattctaaaacatgctgaggaattaccctatcataagattttgttatcttactaatattcatacattgatgtaaaaccttagataaactatttcctgaatagctttcacctgcattaagagtgagatcttttactgcattattaattatataatcatgcaacatatcatcattttttatataaaattctttcttatgttttgtaaccttataaagtggaggctgtgcaatatataaataccctttttctatcacttcacgcatataacggaaaaagaatgttaacaataaagttctaatgtgtgacccatcaacatctgcatctgtcataataataactttatgataacgcactttttcaatatcaaaattttcagttccaatattactacctattgcagtaattaatgatgctatttctgctgatgataatatacgatctaaacttgcacgttctacatttaatatctttcccttcaaagataacacagcttgagaacgtctatcacgcccttgctttgcagaaccacctgcagaattaccctctacaataaataattcagataactctggagacttttcctgacagtctgccaatttacctggtaaaatagtaaagtcaaaaccgttcttactttttatcaaatctcttgctctacgagcagcttctctccctttagcagatctaattattctttctataatgctagtagccaacttaggattagtttcaaaaatatttgtaagcttttcatacactatattttctacagctgtccttgcttcagaacttaccaatttatctttagtctgagatgaaaatttaggatcaggcaattttattgccaatacacaagttaaaccttcccttacatcttctcctaaaatatttacttttgccttttttaagaaaccctcatttgttgcataattattaatacaacgtgtcatagctgatctgaaccctgcaagatgagtaccaccatccttctgcctaatattatttgtaaagcataacatattctcatagtaagaatcattccaatgcattgagagttctaagctaatcccatgttcaagcacaattccctctatatgaacaactttggttacagcagttttattgcgatcaagatattttacaaaagcagcagttcctctatcctctatatcattaactttagaattatccttcaaaccaaaagatgaatttaatatttgagcaccccttaaatcctttaggttcatattaatatttgaattaaggaaggacagctctctaatacgattctctaacgttgaataactaaaatttatagatgaaaaaatattcttagatggtaaaaaagtaattttagtacccttcttagttgtattctcaccaaccacagataacgatttcacagttatcccatcttcaaaacgcataaaatactctttaccattacgccatatggtcaactctaaccaactagaaagagcattcacaactgatataccaacaccatgaagtccacctgaaaccttataactattgtggtcaaatttaccaccagcatgtagctgtgtcataattacttcagcagctgacatgccttcgtcctcatgcatatctacaggtatacctctaccattatccacaacagaaacagacccatcactttgaattacaatatctattttattgcaaaatccagcaagcgcttcatctatagaattatcaataacctcatataccatgtggtgtaatccagatccatcatcagtatcaccaatatacatgcctggtctttttctaaccgcatcaagtccttttaagacagtaatcgaactcgcattataatcatccatagcaacattataagttaattaagttaatagacattatatctgcagaaaattttagataaagtaaaaaaagtctttatttataagttcagtgcattattatcaagcgtataacttgatatacaatgtgcattaattaatattattaattaatacataacgatataccagtaaatttaggttataaaaacttaattctaactacattctataatcaaagctaccatgtaaccagccaatacatactatttttataaatagaattcagattgtaaaaaaatttcattcaatgtttaaataatatgtataatcttaattaataacacttttacatataaaataggagtataatgaagacactattagaggtaagtaatctaacatctgatgacatagaatctatttttaaccttacaatacagtactttaataatacaaacttaaaccataatatcctaactggaaaagtcattgttaacctattttttgaaagctcaacacgtactttatcttcttttgaaattgcagaaaaatcactaggtgcacattctattactttaaacattaacacatcatctataaataaaggagaaagcattatagacactatttcaaatatagatgcaatgaatcctgatttaattatcataaggtcgcaatacagtcaatttatcaaaaaaatatcagaatatctaccaagctgttctataataaatgccggagatggacatcatgaacacccaacacaagcattaacagattactgtactatacgttacataaaaaaagatattaataatttaaatatatctatatgtggagatatattacacagtagagtcgcaagatcaaatataagattattatccagatatggagctaatatatctttagttgctcccccaacattatcatgtaacttaacaggtatatcacatatatatcacaacttaattgaaggaatacgcaatgcagatgtcatcatgttgctaaggctacaaaaagaacgcattattaattgtgttattccttcagaacaagaatactctcacctatatatgctaaaccatgaaaaactattacatgcaaaaaaagacgtcatagttatgcatccaggacctacaaataaagggatagaaatctccaataacgtggcagaaaaaaattctgtaattctattacaagtaaaaatgggtgttgcagcacgtaaagctatattacattatttactgtacaataagtcaatataacatcaataatgcgatataaaattactatagaatataatggatctaattttattggatggcaaaaacaaaaacactcatcaaattccattcaagaaattcttgaaaatgcaatactcaaattttcacaacaacatactacagtatatgttgcgggaaggactgatgctggtgtacatgctttaggtcaagtagcacattttgatttaacaacaaaccttgacacatatgtagtaagaaatgcaataaattatcacttaatacctcatgcaattgccatattaagtgtagaaaaaacagatgataaatttcatgcaagattttcagcaaaaaaacgtcactatttatacaaaataataaatcgttattcaccattaacaatagattataatcgtgcgtggcttatacataatcctttaaatattgaaaatatgatacaagctatcgaatatataaaaggtaatcatgatttctctagtttcagagcaaggcattgtcaatccaaaaatccaataaaaacaatagatgatttaaaaattattcataataatcaatctattaacattcatatttctgctatatcatttttacatcatcaagtacgtattattgtaggtacactagttgagtgtggaaaaaataatttttcaccagaacatataaaaaatatcttaaaagcaaaaaatagatcttatgcaggtatgacagcaccaccatacggcttatattttgtaaaagtagattattaaagttttatacagtacaaaacgtactttcgataaataaaaattcactaataatgcttaagtaaataacagtataaatacatatggttaaacagcatatctaatgtaataccaaaaatatttttatgaaatttacttatagcttttacataaaaaataataggataaatacaaatatttaaaataaatacttaataagatagtatattaacaataataaatatctggcatttttatggattttccaaaacctgttcctacagctttcacataagcttcctttgctgcgaaacgttttgcaaagtgtcttacttgtgcatcaaaatttgtatatttcttactatcttctatttctttttcactaaatacccgtttaagaaatttagtaccaaattttttccataaatttgatatacgaggaacataaacaatgtctgcaccaatccctagtatcatttttttaatttatttaagaattgttctgtggaaattaaaactttatcttttgttaatctattccttacttcaataaggtcttgttctactgttgatttaccaattataacttgccatggcatacctagcagatctgttcttgctaacttaataccaggactatcatcaacttaattacataactataaaaaccattttattacataacatcaaactagctttgcacttaaaagtacaaactaagattaaaaataaaacctattaatagaatttattattccatacatacaaatatttattccttacaacatactatgagctatacaaaagatttgtaatacaatcttctcacagttatttttattcacaccatttaaacactaaagcaaacgtttttctagggtttagaaattagcttatataatgcttgaaatcttacaataccattttaaatacaactttaaatttttctagacacatagtctttgctaaaacaacattatccataaattaatcatgaatacagaaataaaatataaaattagcaaattctattttacttgcttaacttactattgtaatttattgctaaattgacgaagtaagctatcatgtataccagtaactggtgtattcttttttagcaattttactaaactctttctatccaccttaatgttttgtatatccgttaccttattagcttgagaatcaaaagttatttttaaaacaagagattcatattcttttgttgaaaaaaaacgcttcttataaatactataagaaacataataccatacattttcctcaataatgcacggatcccctataagttgtataacctgactacttaaatccccaacctttacattattccacaaattaacttctgaagcaggatagccatggtgaatagatatagtatgacaactacttaataaaaacaaagctatataaataactctcgttagcataacatctcaaaaataagtatcgtgtaaagttatcataatttaattaactggtcaatttcatattatatatttttaaatatatacctattagtaaatacaaaaacattattctacaaaatagatgcttacagttcacctttccaatgcttgatttattaggtctatagtattatttactccatataattttacaaaagatccaagcctagggccatgactttgccctaatagaatttcataaaaactttgaaaacaagatcgcagatcattaaaacaatattttttcattaaagaaaatatattactttgtatttcttcagatgtaatattttctgagaaatcattaagcatatttttcaattcatctaatatgattctttcatcatgatttggagttttataaaccttatatggttttacaaaatcatgataatatttaactgaaaaatctactaattgagataatattttattatcttgtagattatcattatcttggtaattttcaatgaatccccataatacttcactagtttcagcattacaagcagatgctaaattcaataataaagaaaaacttaacccagaaatattaattaatggcacatttccattatgaatatgccacacaggattatcacaactaacatttttatgataatcatccactagacataaataatcatccatagaacgcggtataacatcaaaatataacttctttgcctttttaggattctgtaatatatataatgctaaactttcagaaggagcataagacaaccaatcttctattgatataccattaccttttgattttgaaattttcctaccttctttatcaagaaacaactcataacagaatagaaccggaggttcactacctagaatctcacatattttactagataattccgcagatggctgcaaatctttaccatatgcttcatactttacattaagtgctgaccatctcataccccaatctggcttccattgtaatttacattttccacctgtaactggaacttgaataacttccccattctcatcctgataagaaatagtacctaatgcaatatcaatatcaacaataggcacttgtaatactcttgacgttctaggacatattggcaaaaatgggctataagttttttgtctttcactacctaatgtaggcagcataacatccatcactttatcataatttttcaacaataagagcaacttttcatcatataaaccattcttataacattctgttgcacttttaaattcatattcaaaattaaataaatcaagaaacctacacaacaacatgttcatatgatgcccgtaactttcacaagcacaaaaaggatccggtatcatagtcaaaggtttacctaaatggtcagctatcatatctttatttggaatattatctggcactttccttagaccatccatatcatctgatacaactattacttttgttgtaatattaggacagattttacgtagagcattcattattgctgtagtacgtaatacttctccaaaagtaccaatatgaggaagtcctgacgggccataaccagtttcaaaaataatttctgtattctccccaaatctttttaatattttttctgcttcttgaaatggccaaaatttgtactgtcccaccataatacataaaactgatagcttataatctcactcacctatataacacaaaatgtataaagtggcaaatatatagcaagattacacaaaatgaatttcgaaataccctataaactattttaaaatagtatcaaaaaatcttttctagaacataactataacttttatttagtattcctaaatcaagcagataattgagataccgcagcttcatcaaaaatgctaccccggtcacctttaagacaacaagaccttataccaatatgtcatggtcatacaacaaattaaagggttttaacatttataggaaattactccaaactatactggatcatcatgcataacaacacgacgttgctttattttcttatgcataacccccttcttacgactatctacagattcagataagcgaaattttatataattatcaacaatctcattaaacttatccatatgatcacggaagaaatgatctgctttttctataacataatattgcatgtactcacttttaatagaattactcaatcgagcagctagttgagatactgcagcttcatcagaaatgctatcctggtcaccttgaataattaatccaggtacaggacaaggtgataaaaatgaaaaatcatatttattcgcaggtggtgacactgctatgaatccttcaacttcaggacgtctcatcattaattgcatagcaacccatgctccaaaagaaaaaccagcaacccaaaaaggagatgatgccatattattattttgtaaccaatctgctgctgctgcaccatcacttaactcacctatgcctttttcaaaattaccagatgatttacctactccacgaaaattaatccttaaaacagaaaatccattattagcaaatatattgtataaattatatacaatcttattatccatgtttccaccatattggggatgaggatgaaaaattaaagcaagtggagcacctaacgttttgttatgatgatatttcccttcaattttaccaactgcaccattaaaaaatatctctctcatgaattaacttccttaaataaaaaatgagcaaactactatccaagtgtataacaataagaaaaaaaactcaactttacaaaagtatttttataataattataagaaataagaaaattcagatacatattttaatttatattatcatatacaaaaacttattttaataataagactaatatattaatcttagtatttagattagcaaaaacctacttgacataaggtatattaatgatacattaacagattgttgattgtaataaaaatctttcataaaaatatttcaacaaaatcgaatgattataaagatttggaaaatttaatatgttaattacgacaaggctacgttatgctgtcatgtttatggtaaaattagctcaggagtattacacattaaaaggtagcactcagccaaaaaggatgtcacatattgcaaatagccaatccctctctgaaggatacttagagcaaattattgtaaaactaaaaaagcaaggattaataaactctacaaaaggccctggtggtggttattctttaaataagagtccaaattcaattacacttaatctaattcttgaatccataggagaaaatataaaaattacaagatgtaaaaatcatctcataggatgcttatcaaataatgctagatgtattactcacaatttatgggataatataggcaatcatattaaaaaatatttaaatagcatttcattagaagatatacttaacaataattttaaatctggcacgactgtaaacaataatgctaatgaatatatatatgcagattataattcaacatcaactatattacccacagttaaaagtcaattagataatctatcttctctaaacatatacaatccgtcatcaacacataaactagggcaaaatacaaaaagtattatagaaaaaacaagagaaatagccatcaatcaattaaatgctaaaaatcatgacgtaatttttacttcatctggtacagaagcaaacaatttagtaataaatagtactgctgattataaatacttaatttcttccatagaacatctatctatcatgaactgtgcaataaatgcagaattaataccagtagattctaatggaacggtatgcttagatacattaagcgatattttatacaaatgtaaagatgaaaaagttctcgtatcaataatgactgcaaataatgaaactggagtaattcaacctataaaagaaatagtagaaatatcacataaatttggtgcaatagtacatacagatgctatacaagcatgcggaaaaattcacgtagatattgaagatttaggggtagatttactaacaatttcatcacataaacttggtagtattgctggaactggtatattgttttttaatagtaaaaaaataaaaataaagcctatgatattaggtggacaccaagaaaaaggactacgtgcaggtactgaaaatgttgtatcaatctatttattatctatatctctaagcaatctaaaagattctataaaaaaaatgtctagtgttgagagattacgtgataaactagaaaatcaaatattaaacttggtacctgaagctcaaatttttggcaagaacacacgaaggttaccaaacactacatgcatttcgatgccaaatgtaaacagtgaaatacaaacaataagttttgatattgataacattgcagttggtagtggatctgcctgttcttctggagcattagaacattcccatgtattagctgcgatgggaatagatgataacgtagctaaaaactctatcaggattagtcttagtcctgatgtaacagatgatcaagtaaacaaaatagttaattgttggtacaagatatataaaaataatcaattactcaaattaaattaggtagaagtgatgaaaaaattagaagattattatattatgagtagtaggtcataagatggaacaagaaaaacgacaaatcaatttacctgtgtttctcgactatcaatctacaacaaaaacagatgatagggtattagaagctatgatgccctactttaaacaattttctaatcctcactcacgcagtcactcctttggctggaaagctgaatcagcagttgagttagccagggaaagagtcgcatctttaataaatgccgaagctaaagaagtaatattcacttcaggtgcaacagaatcaaataacttagcaattaaaggagtagcaaacttttataaaaacaaaggaaatcatataattacagtacgtacagaacataaatgcgttttagattcatgccgttacttagagacagaagggtttcatgttacttacttagacgtacaaaaaaacggtatcttagatttagagttattaaaatcatctatcactgataaaacaatactagtatcagtaatgatggtgaacaatgaaattggcgttattcaaccaattgaaaaaataggaaaaatttgtcatgaacatggaatattttttcatactgatgcagctcaagcttttggaaaaatatcaatagatgtcaaaaaaatgaacatcgatcttttaagtatatcaggacacaagatatatgctccaatgggaataggagcactatatatacgcaaacgccaaccacgagtacgccttactcctatgattaacggaggtggtcaagagcgtggtatgagatcaggaacagtacctactccattagctgtagggttaggagaagcagcacgtatagctcaagaagtaatggaggaagaaaacatcaggataagagaattgcgagacattttatataatgaaataaaaaaacacttaccatatgtcgtattaaacggggattacgaacaacgtatagcaggaaatctaaatttaagttttccatatgttgaaggagaatctataattatggcaatcaataatctcgcagtcagttcaggttctgcttgtacttctgcttctttagaaccatcctatgttttacgtgctttaaatattgaaaaagacttagagcattcatccatcagatttggtataggtaggtttactacaagagaagaaattttatatgccgcagagcttattgttagcagcataaaaaaattacgtgagatgagtccattatgggaaatggtccaagaaggtgtagaccttaataatatcaaatgggatgcacattgattatgttattatattgtcgtaattatgaggtaattttatgagttatagtgaatctcttctagagcattacaaaaatcctaaaaacgtcggtactctacctaaagaagattataatgtaggaactggactagtaggagctccaagctgtggagatgtaatgaagttacaaataaaagtagatgataatggtaaaatcattgatgcaaagtttaaaactttcggatgtggagccgcaattgcagcaagttctttagcaacagagctaataaaaggtaagacaatagatgaagcacatcaattaaaaaatactgttttagcaaaagaattaagcctgcctccagtaaagatacattgttctttacttgcagaagatgctgtaaaagctgccataaaggattataacatgaagcaagcaaccaaaaaagacaagctttcatcttcaaatgaatagatatctattaaagtaaggtttacatatgatgaatagtgaaactcctacattttataatagtgaagacagtgaagataattcatgcagttcacagatcaagtatcacataaatagcaaaataacaaacaaatctcccattattattacagaaagtgctataaaaaaaataagagagcttattaaacaaaaagaaggtgctgttattggtatcaggattatggtgaaacaaaaaggatgttttggtctcaagtataatattgaatatgcacatgatatcaagctattagatgtagaaattaaagtagaatatcaaaatgagaattttactatattaattgaccccaaagcaatgatgtttatcaatggaacagaaatggaccatgtagaaaacaaaatatcttcaggttttacatttaataatcctaatgagaaaggaagatgtggatgtggggagagtttctatgtataaagactatttttcattattcaagttaaaaccacaattctctataaacatgcaaacattagaacagaattacatagcattacaaagcaattaccatccagatttattctctttaaaattagagaaaaaattggcattagatactataacagaaataaacaaagcatatcaaactttaaaatcttctataaaaagagcagaatacttattagaaatcaagggaattactactaataaaaatgatattaatatactagaagaaatatttaacatacaagaatcaaacagcattgatcttcaaaatcaaattttattatccactaaagctatggaaaatgctttttctgtagaagattttaacgaagccgcaaaacaggtagtaagattaaaatatcttaaaaaaattcaagaggataggagtattacttcatgcaattagtaaacataacagaaccagaaactagtgaaaaagtattagcatttggaatagatttaggaactactaattctttaatttctatgattgatagtgaaggcaaaatcatcatattttccgatgaagatggcaaattccttatttcctcaacagtaagctacattaacaatcaaatacaagtaggaaaaaaatattccaataaagctatctgttcagtaaaaagattaatgggaaaatcaatcaaagatataaaaaaattatctttagatttaccatttcatataattgataaaggtgataataacatatacatagataagcaagatggtacatatgttacaccagttgaagtatcagcagaaattctcaaaaaattatgtaaaattgtaaaagatagtactaatctagaagtaaaaaaagtagttataacagtacctgcatattttgacgaaacagctagaaaagcaacaaaagatgcagcacatcttgctaatcttgaagtattacgtcttttaaatgaacctactgcagcagcattagcatatggtactgaaaaaccagaatgtgagaacaatatctatatgatatacgatttaggaggtggaacatttgacgtttcaatactgaaattacaccatggagtgtttcaagtattagcaactggtggtaacacaaacttaggaggcgatgatatagattatctacttgcaaaattgatatataacaaatatcaacaaacagaaaatgttaatgatacaccattaaataaagaattgctaaatgatttaattgcagatgcaaaatatgcaaaagaatacctaagtgaacattatactggaagttttacttttaaaatccatgacaaaaatttttcttgtgaactcagtagagatgaattagaaagtataatatcagatttattaaatcaaactttaagtattgtaatttcaacaatcaatagtatagaactgaattttagcaatattgaaaaagtaatattagtaggtggatctactaaaatgcctataatcaaaaagatgctaaacaatatattccacaataaagtattttgcgatgtagatcccgacaaaatagtagcagttggagctgcactacaggctcattatttatccaacccacaaataacaaacaaaaatgttttaatagacgccttaccactttcactaggtatagaaacaattggtggtattgtagaaaaaatcattcccagaaatacacctatacctgcatctgctacacaagaatttactacttacgttgatggacaaaactccatacaaatacatgtttgtcaaggagaacgagaaatggtagaacacaataaatcattagcaaaatttgatctaaaaggaataccaccattacctgcaggtactgcaaaaattatagtagaatttaaagtagatatggatgggttactaactgtttcagcacaagaaaaatctacaggaataacacaatctatcagcataaatcacacatgtgaattagatcaaaaagaaatagaaaataacattatcgattctataactaattttgaacatgatatgcatatacgctcaatagctgaacaaaaagtagaaggacaaagaatcattacacttattaaaaatgcattaattgaagataaaaatttaatatcagaattagagttcaatacaattaataatgcaatcgcagaagctgaagaaatattactgaatggtaagactgatagaattaaagatgtcataaacaacgtagaaacacaagcacataattttataaaaaaaagaatggatttttatctaaaaaaatccattgataactgtaatattaataattaatacatggaggtatgttgtgccattaataacattcatttcacctgatggaagccgaaaaacttatgaagcttatgatggagaaaccttattaagtttagcacatagaaataatgtagatttagaaggtgcatgtgaaggttctttagcatgttcaacttgtcatgtaataattgatccaagttggtatgatatagttgaacaacataatgaaatctctgatgaagaaaatgatatgcttgatttagcatttggattaacagacacttcacgtcttggatgtcagatcattctcacaaaagaacttgatggattatgtgtaattttacctactgaaacccgtaatatatcttttgtaaaaaatagttaaccagttataaaataatgaagtattttaataaaaaactaattgtaatatcatcaattgttattgcatcaatttcgtctttatacataggtgtttggctcgttattgccactcatgtcaaagcaactttatcaaaatctttagcatatatccatgcagagcatagtaatgatatacaaattacgaacttcccctttattccaaaaataaaggtattaaacttaaaaataaattcatcttcattaaatatatccattccatcattgtcattaaaataccatttattaagcaatacattagaatttataggtttagataatgctacactaacatttgaaaattcaatgaagatcacaaacaacgaccagaaaaatacttcagtttgtaatctacatgataacttcaagttattaattaaaccttctaaaaatttattactttttttattagataataaaaacgataagaaagcatatttcacatccatggtatatgaagacaatggtataagttgcaataataatcacattataaataaaagcatattttctgtagaaactgatgaacacaaatctttcgataacctgataacagtactacaatacaaaatcaatgcaagtgctgctagtaatacagatactaacatcaatgtaaaaataaaagatgctatagtaacgttaagtatgtcaaataccgaattcaaagagattagtgctataatagataatatagcattaacatccaggaattcattaatttcaatttatggtaagctattactgccattatctctagatacgcaaattaatgatgaaaaattaattatagaaataagtaattatcaggatatcattaagcaattagtaaaaatattatatcctaaatcacaacataaagataaaatattttctgctctacaagattatatatacgcaatttccgaaaaaaaagataatggtaatattatattatcggtaagtgagacagttaatccttttaatatttttatttgcaaagttccttatgaggaatttattagtaaaataaaagctattacaaacactatggataaccatgcaaataaaaagtaattcagtatttattactatattagcattctcgtttttttccgttttttctgcctactctttttcaatagatgagaaattagtcaataatgaaatggaattacgtgcaattgatctatttaaaatagtaaggtgcttaatttgttctggtgaatctatttatgaatcacaatcacaattagcttatgacatgcgcttaatgatacgcaataaaatcaaaaatggctacaatgacaaccaaataattactgaattacgaaattattatggaaatcaaataactatcctacctccttacaatccatatacttatccattatggatattacctattcttatttttggaataggaataattataataataaaatttatttattataaaatataggataattcaaatagttatagttaattattaatttatcatattaaaactaataatattaaaacctatctgctggctaactagccataccgcactaaatgtaaaattaaaataatcctaactacttaccttttgtgcagctaaaatataatttacagaaatatcatcggataatacccaacttctccttatcatattaaaattcattcccataatgtttttgacacatataccattaagtgaaaacaaatttacgatttctgaaggcttaacaaatctaccccattgatgtgtcttacgcggaaccaattttaaaatatattcagcacatactattgcatacaaaaaagatttcttagttctatttaacgtagataagaatattatcccattatcacttaatgcattgcttacagcattgacaaaaactggtaaattatcaacatgctcaattatttccataatagttataatatcatacttttcttcggtattaactaaagattctatatccatacaggaatactttaaattacataaaccacgttctgaagcatgcactctcgcaatattgatactttcttcactagcatctataccaaaaactttcatacccaaacgagacatagattctgataataaaccacctccacatccaagatcaagaactgacaacgacttaaaatttgctttaggaataatcttacttatataatcaacaatatatctcattctcaaaggatgtatatcatgcaaggcttttaatgggccatgttcatcccaccatttatcagctatttttgaaaactttaataactcattttgatcaaccgtttgactcataaacaattatctatttttgctattctttgtacatgcctcccttcagaaaattttgtagtaatgaactgataaactatagactgagcttctccatgattaatatatctagcaccaagacaaagtacattagcattattatgctcacgtgctaacttagctacttctacattataacacaaagctgccctaatttttctgtgacgatttgccacaatactcatgccaatacctgtaccacatattaaaataccgaaccctaaagtgttaatgacacaatctacaacattttgtacataatccgggtaatctacagcaatactagattccatgcaaccataatcctctactacataacctaaattgcttaaatataacttaataactaatcttaactctattccagcatgatcagaagaaatgaaaattttctgcatagtcaacataatttaacatgatctaatatctatatgaaatactatgaaaagtcaatatcataaacatagtcacaacccaaacgttacaatttctctttacaatttcaagataatggtgtaaaaaacctactataggttttatagtaagtgtggatatatgaacaacgggaaagaagaatcagagaacatcataaaatgcactttatcttatttaaataatacaaaatcttacacacatgcatttaaaaaaaatatcatagaagcttttgaatccggactaataacagaagatcaatttactcatatgatatatcacgtaacaaagtttataaaaaaaattgaagtatatgaaaatatatttctaggaatatatcatgattacatcacatgcggttagtattatgctatccttatcaacaacaataattaactttcctcacaactttaagaaaaattaataataagtacaatctctttccttatcattttatagttttatgtagatatacaaaaaggtaataatattcataaatgaatttttagctctattacatcaaaacatattcagtatatatacttattttaaatactctatgcccatacagtattttatatttagaaaatccgtatcgatctcaaataacgtaatattagcgtgcttgcacattatggctgtttgctgcttgaatcaggcgttttttataattatcattgtctttccttataatcgaaaaatatctttcaggaatagtcaaaccatctttaccaacactctccatatctactaaaaaacttcccttaaccctagcctgataaactgtacgtaactttttagtttcttcattaactgcaaatccaataacacatattatgcaatctagagaaatcactttatctaataatttcacagcattatataaattgcctattccaggcttataatgtccactttcattactaatataatgaataataccattactgacacttagtaaaccagcacatattacaggcatacccgcagctaatgttgaatgaaaatatgtttgaccttgagtacgatcacatactatatgatcatgagttattaaatttccctctaacgtaattacatatgcaactttactatttgtactatatatttgaccatcataagaacagagtacaggtctatttttttccctgataaaccttgtatgatatcgtcgttctgctaaagaaaaccattttatatccaataaacaatttcgataaaatacctcaacatttagtttattcttaaaactaatttctttataaactatatcatatccttggctatattgcattacacctgtagctgtcattgataatataggtttacgaaaaatatccatactaacttgttgctcttttggaatgttataccaactcttcgtagcaatcttcctaatacccataacaacttttcttagaaaaataagactatttttcctataaagtttaacaatttgctgactaccttctttttcacgtacagtatgtaacaatggcatcaatattataaatataataagtttatttaaatattatattaattcatttatatagtaaatattataataacccttttaacaataaaaaaattaaaggaataaaacaacaacaaacacaaatatacaaatcttgaataataaaacatataaaaaatatgcattatcattcaagatcacactacgatatgcttatataataattaaaacatgaaattcagattataataaaagcttataaacaagcattaaatattacttactaactttctaattgacataacagagtcattaaatacattcttttcctcctcagttagttgaagttctattactttttccactccatttttaccaataattacaggaacacctacaaatagatcatgaactccatactctccctttaaataaacagagcaagataacattaatcttctatcattcaaataagagtcaaccatcaataaagcagactcagcaggtgcataataagctgaacctacctttaataaatttactatttcttctccaccttttctagttttttctataatctcattaaccctatcttgtgtaattaaattcattttcaccagatcagcaatagatatcccaccaactgatgagtacttaactaaaggaagcataaaatctccgtggccacccaatactatagaactcacactatctactgatacattcaattcttttgcaataaaataagagaaccttgctgcatcaagtaccccagccataccaacaaccatattacttggcaaatgagaatatttatgcatagctaaaaccattatatcaagtggattagtgactactacaacaaatgcattaggagcatatttagcaatattttctgctacttcttttataacatgcacattagtattaatcagatcatcacggctcattccgggctttctagatattccagcagtaacaatgattgcatcagcaccttcgatatcagcataattgttagtacctaatatctctccattatgttttgctactggtgaagattcagcaatatctaatgctttacctttggctataccaccattgacatctaataaaacgacatctcctaaatttcgtgacctaactaaatatgctatcatgccacctatactacctgcaccaataagagcaatctttttacgttttatcattatttcctctactttatttcaagaccactacttatgaagtttacctgattatagaatatatacaatacttaatctaactaactattacttttcgtagtttctaatacaacactaatattaccatttgtaccacaagtaagaggcttatataactttaaataacagtgataaattttttcatttgtcatgatataagctaataaatctgatgccatcgtttccaataataaaaaacgacgcgagttaacaaaattaattaaattatcagtaaatatactataatctacagtttcatcaatatcatatattagatcattacaacaaagagttaagtcacaatctattattattttttgttttataactttctcccaacaacgaactcctatataagaatagactgtaaatccatgaatttgtattttcatcttaatacattttgtaataaataataaaaaagtacatcatcaataacaaaagttcaataaaacatctaaataactcttactttattataaattcttctgataccagatgtataattttttataaaatactgtcacatttagttttatatagtataaatatcaatgttgagataactgagagtaatgtaaaaatgtttttatataactacttgcctttctttaaaaaaaagaaacaagatcaagataccaacaaaatttgctattcaggaggaataagaagatttagtagtatattaatagatttgactattttaatatttatcttacaaattatacacaacgtatactcttactttttcatgcatgaaacagataacactgtaataaaaattatagaaaaatacaaaatgagtgtaccattaaccgcacaagaagaacaaattaaaaataaacatgtatttaaggctatttgtggacaaattattcagatgattgcactttacatatacgctgcatatagttggactaaattctctgcaacactgggaaaatttcttacaggattaagagttgttgatgcaacaacttttcaaaaaataacactatctcaatcaacaaagcgtatttttggatccattctttcttctattccactatgtttaggaatagtatggtgtaattttaataaacgtaaacaaacatggcatgataaaatagcaaatactgttgtagtaaccaataagagtttaaaaaattaccataataatcataacttatgattataaaaaacacattttctagataattctttactagtactactaaaaactaatctataattataaaaatgttcttgataaatattttatgccagtcaagctttcatctactttcttagtatatcaaacctcaaattttctaaaggccaccttgctcttggaaaaaaatttaaatttgaaacataaccctttgctaaattttcaataccagcccatcctatcataactccattatcagtacataacttacttggaggatacaatatttcaaaaccattatcatttgcacatactgacatacgattacgtaataatttattagctgcaacaccaccagttactactaacttattaatcctgtgatctatatcttttgacattacaatcgcgttgttaatcctgtttaccaatatatcaccaacacaatcttggaaagatgctgaaatattacataccaactcatgatttatacacttctgacctgcaataatatttctcacagcagttttaagtccagaaaacgaaaaatcacatccaggacggttagttaatgctcgtggtaaagtaaaacttccactatcacctaacaaagacttctcttcaataattggccccccaggatacccaagatttaacattcttgctactttatcaaatacttcacctaaagaatcatccaaagaagaacctaacttataataacaccttacatcgtaagctaccaagaactgacaatgccctccagacattattaacaataagaatggaaaatctatttcataaaacatacgaataattaaagcatgagcctctaaatgattaatttcaataataggcttaccagtaacactggaaattgctttagccatcattatgccaactattaaaccaccaataagaccaggacctgcagtaacagcaatagcatcaatatcattaaaacaaagttgcgactcctctatacaactaccaactaactcatataaataattaatatgagcacgagaagcaatttccggaacaactccaccatatgctgcatgttcctgctgtgaaagaattttatgtgataaaacctccttattactatttacaatagcaacagcagtttcatcacaacttgtttctatacctaatactatttttaatttatccacactttcttattttatagctccaatttctttataataacgttcagcaccatcatgcataggagtaatacttgactttgccatatcttgcacagtaagagtttttaaagccccagtaatgctacgaagttctcgtaaatgagttgctatagactttactatcttatatgctaaatcattacttaactctgtagtagtaaccagcgatgccttcactgacacagtctgtatatctggtgaatcattatataacccaccactgataatatctttttggtaatagggatacttagcatgtaaatcatctattaatctatcatctaaaggaataaattttatatcacaagttgcagatgcttcctgaattgaagcattaggatgtccaatcacatctaccattacatcaattttattatcacataaagcttgagcttgctctgatgattttaattctgccatgacagaaaaatccttcttagtccaacctttttctcctaataattttaacattgctacccttaccccagtaccaggactaccaatattaactcttttgccttttatatcatcaataactgatatattggagctttttttaacaacaatagtaagatactctttatgcagagatgctaacattctcaaattatccatcggaagcattttttcataaaaccctaaaccattatacgcatagtactctaaatctgactgaacaatacttatatccatattcgaataacgtatagaattcaggttatatacacttccagtagtagaagaaatagaacaaataatcttattatccttaccataatcacttgctataaatctacaaatactacctcctatagggtaatatacccctgtcatagaaccagtaccaattaaaatatattctctatttaaactatcatctgacgaggcaattgcattattaaaaagtacactaataataaatacatacacaattaacacttttttcattaattttgcctcacatttacagcaccatatattatatcgcaaaaactacttacctttaaactggcactaccaaccaatacaccagacaattgatttatagcaataacatcctttatgttactctgattcactgcaccaccatatataatattagatttactatcatacgaccttataatatctaaagattcagttatcatatcaatagaaggaatagtattacttcctattgcccatacaggctcataagctataacaaactcaccatgtttagggaaagaattataacactgatctaataaagcattttttaacataccattttctctatctaacaaagtttccccaatacaaataattggaattaaccctgcatctattgcagattttgccttcaactgtacacaataatcagattcataaaatatgcttcttctctcatagtgacctactattacataactgcaaccacaactatacaacattttagcactaacttccccagtatatttcccttcagattcataaaaacagttctgtgcaccaagtttaatattgggagcacaatcaactatcttagaacatgcaataaaaggtggacacaataccacttctacatcagcctttacattaactaaattagcacttaattcttttgtaaaagaggaaaaagtaagaaagtcaccatacatcttccaattagcaacgatgagcaatgacataaaaattactaaaattaaatgtgccggctataagacttgaactcataaccctctgattacaaatcagatgctctcccagttgagctaagccggctggaactttttgtaattctatatataatattataaaagtcaatacccagaatcatattttatatatttaatatcactttacatgtataataaacataaattaccatcatatattcttataatcatgaatcatattagtaagataaatcctaaaaaagaattaagccaatgttttatttcgtcaacccatattacagatcaaatagttaactatgctggcaatatcagtgattactcaataatagaaattggtccaggacttggtacaatgacttattctatattaaataaaaaccctaaaaaactaatttctatagaaaaagaccgtaggttatcaacaatacatgaaaaaatagttgaagaatttcaaggaaaatacgaatttatattatcagatgcactaaacatagatttacgtgatattattgaacctccagtaaaagtaatagcaaacctaccctatcatatagcaactactctattaataaaatggatggattatattaatttttttactagttttacattaatgttccaaaaagaagtagcagatcgtatagtagcacaaccaaataataaaaattatggtacactatctatactcattcaattactatctaatgtgtataaaatggaggattttggaccagaaatattttcacctcaacccaaagtaatgtcatctgtaattaacattattgcattaccagaacccagatttcatgtaaattatagaaagttatctcaagtattaaaaacaacatttagtgaacgtcgtaaaatgatacgctctacattaaaaaaacttaccaataatgcagatgaaatgctagaatctcttaacattgataataatttacgtcctgaaaacttatcaatagaacaattctgtcaaattacaaattgtataaactaaatatcctatgtatgtgaggctttcgatataaattaccaaaaatatattgttattttaaataataaacctagcttttacaattcatctaacaattttctggtataccttttgaagtagaatattgaaaatttaacggagaattagggtatattacatgatatatatgatgacatgccattgcagcctctgaaaatcctgtaagtattaacttaagttttcctggatatgtagctatatcaccaactgcatatattctattgcgatttgttagacaagtctcagcattaacaagaatttgatagttttttacttccattccccaattcaatataggaccaagatttgcagatgtaccaaaaaatggaaataaataatcaacttgtagcgccatttcttcatgattcgtaatattcttaacaattacagaatgcagtttaccattttcaccacataattttttaacttgatatggaacaataatctttatttttccactctgtgataaattatccatctgcaatgcagtattaggagcacaacgaaaatttttccttctatgtactacatataactgtttagcaaccttagaaagctcaactgcccaatcagcagctgagtcacctcctcctgctatcataatatttttatcacaaaaatctgaaacctttctcacttggtaaaatactgatttattctcataatcaagaatattatctataggaagacgatttggaccaaatgctccagctccagcagcaatgataataactttactttgtactacaattcctgttgtagttcttatcaaaaaataatctgagtaatcttctattttttcagcaacttgtcctaacaaatattgaggattaaaaggctcagactgcttttttaaactatctattaattccttaccattaattactggatatccaggaatatcatatatcggtttctctggatacaatgcaagacattgcccaccaatttcacttaatgcatcaataacacaacatcgcattttcaacataccagcctgaaatacagtaaatatcccaacaggaccagctcctattaccgcaatatcagttacataatctgtcatatttttctcatatattagccaagttttacgctaataccttaaactaaagaagaaaatttatctagaaattttctataaaattactgcatatactaaatatcaaaaagctttacaataaccaaattaagaagattttcacaaaaaatatatatcaatttatatgctactaataatacttataatcataagttatggaaaatataacatttatatttcaatgttaaccaagaaaataattattaagatactatataattaattatgtacacacattacaatacccagtccaatattaagctacataaaactaactttacaaatagttaccactaatatttaaagtatattctaataaatataacattaagcaccacaataacaaatacatagtaaatcataacaatttacctaaaacatatagaacaacactatttattttattatccagcaattgtaatgccatctattcttattgtaggagaattgactgaactaaaaaataccaaatcatttgcaatggacatttcagaaaacatatattgtaacttactagcaatggtgatttcatttactggataagatattttaccattctctataaaaaatcctgatgcaccttgactataatcaccagtaattaaatttactccaaaaccaaaaagatcagtaatataaagcccactttttatatctgagattaactcttgaacagacaaaattccattctgtatataaaaattgctaacaccaggacttactgatgcattagaatgccttacagcatttccagtagttttcagtttcaacttattagctgaacgtatatctaaaatccaactttttaatataccattttctactactaactttttattaccaacaactccttctccatcaaaaggccttgaagataggccagataacattaatggatcatctactataaaaatgtcatctgaaaaaatctttttattaatataattatttaaaaatgaagcttcattagctatattatccccccttatagcactggcaaagttttttaacaatgtaccagctaccctattctcaatcacgattggtactttacaggtctgtaattttccagggtttaatctcttaactgctcttaatgcagcttccttacctatttttacaggatctttcatacgacttaagttgcatacggaagaaaaatcatatcctacttccattttatcatctgtaccagcaataacagaaatactacttacaaaattagatttactataagaacctataaaaccatttgtagttgctaaaacaacatctgttataccatgagaaaatgaagatccttctgaattgacaacttgattatcataagataacgcagcattttccatatcttcaacaatttttttacattgatcaactgtaatattagtcttatctaatatcattaggtcattactagttaacaaatgttctttattaataaaatcattatataaagaaatatatggatctcctgtagataattttgccatagcaacagcttgatctatagattctgatacattagaaagttcattagaagaaacacatgcaaattgattattattcacaataactcttattcccattttacagtttttagattgaataacttcatcaatcttatggagacgttgcgataaagataacctattattctgataaattactacatcaccaatgtaacccatactttttatcttttttacagcatcttcagctacatttaaaatctccaatttatcctccatcaaccaatactagaaaaaaattctcttcttaattccatgttatcttgaaaaactccaattgcacaagtcgtttgtaattccaaattatgcttgtcttcctcttcacagcatacaatacaatcatgtactgcttcaacagcaacaattatccctttcggagctaaacaatgatctaaggcgtttgctatttctacagttaatttctcttgaagttgcaatctttttgtaaaacagttaattaattttacaattttacctactccaaatactaacttatcaggaacatacccaatactaattttacctctcattggaacaatatgatgctcacaatacgatgtaaattcagtatttttaaaaatcaccatatcattataattctcattaagtaaaactaaatcttgcatagaatatatatctacttgatatcctgaaaaaaatcttttatagacatccaatacacgtttagcagtattaacaagaccttctctatttggatcatcacctatccatcttattagtaaattaacagcttcttcggcttcactatcagaaggtttgccatttctcataaattctcacttattaattcaacgattcaaaaccactaattatctctattaagtcagtagttatagaagcctgcctagaacgattatattctaatgccaacctatttaacatatctttagtattacgattcgcagattccatagcaaccatacgagaacaatgttcactagcagaattctccaaaaacgcaatatacattaaatttagtacataacccaaacttatagtagataaaacatcaacatacgttggttcatattgatatacttctttcaacaacataggaattccaagattacaaggaattaattgttgagcatcaggtttttgtaatatagtcgtgtaaaatttattaaatagtatcatgacattatcaaactgatcaaaatcaataccactattatatacaaaaagcttaaaatacaaaaaatctgtaatagacttagtattagaaaatacattcaatatcttatctgaatattgactatacatcatatcatatgcctttttgccaaaaaatattaattttacttccttattactactttctaacttttcaacataagatttagtaaacttaactatcaaattattaaaattaccacataaccctctatcagaagacattacaaccaataaaactctttcttttttagctatagaagcacaattatgcaccccatccgaaggaacataatctacaatactactaagctctaataagtgttttttagcattctccaatttttgctgaacgcgatgcagcttagcagcagatatcatctgcataaccttagtagtcttttgtatagacttaacactttttattctcaataataaagctttaagattggccataaatcttaattaaaaatacctaactaaagtatattatcttttactagttacacaagaattttatacagataaaaaactattcctattacataaagcgaccgtgtttttttcttacatcaccagacttaggagaaggtaaaggtgctacatcatctaatgaagagtcactactactattaattactccttgtaatcctgaagcaatctcagtaacactagtatccatcaatacatcaccagatccctttcttttgcgccgtgaagaagattgcttatcagatgcctcagatcctttctcctgtgatactaaaccttcaaaaaatcgtaatttctcagaaaaatttctcttatatcgttcccctgccctctttacaattataggatccaaagcgtcgtctgcttcagtaactccactgcttccttcttctcttatactatcgaaagataaatcttttagaccttcttcagactcttgactagtatcctccgaagttttagaaaatccaaaagcttttaacactaatttcgtacttttcaatgcatatgatgacgacgttatatcacctgttttttgacacgcttgttctgatgatgcggcaacaccaccttcagtgttacaaacaaccccatcatccaaggataaatcttctagagtgtcatcatcacattgacttatatcccatcctgttctagacaacttgtaaagactatctcctctaaattgccctgtagatgatacatcatcagcagataaagattttttacttatctcatcacctccagcagtaggaaggtctccttcacttttagaatgctttataactcttggtatcaaccctggcattaaaatttcaccttttacagatggtttcacgtctttataaatcttactgtcattctcaattctaagttgaagtccaatatttcttaaaccctgtaaggcttgtttcaatatatcctcagtaacatgaacttcttccggtaacaacgtaggcgatgcttttccaccttttcctgatccttttttagattccacacctcctcttaaatctgaacttagttggaatgctgctgaaccgcgaggaattttagatgtacttttaccttgttctgatcctgctactaacttttcatctgcacctgatacaacactttgatcaacagtcatagcttgatctgaagtacctggactagatgctgaacttgcacccaccactttatgttgctgttgattacttaaaccgcttggtaatacacgagacgtgcttctatcctcctctgatcctgctactaacttttcatctgcacctgatacaacactttgatcaacagtcatagcttgatctgaagtacctggactagatgctgaacttgcacccaccactttatgttgctgttgattacttaaaccgcttggtaatacacgagacgtgcttctatcctcctctactcctgatactaactttttatctgcatctgatttaacaccttgatcatgctgaccctgagatactatatcaccaccacgttcttgtaccattaaactactatctacagtatcctgatccggcaatgaaatttcagagcccaacaaagtcctattctcattacagaatctttcatattcttcctcttcctttaaaccaaaatctaataacacttcttgtacactttctaacacttttacaacatttggtttttctgtcactgataaactactaagacctacactacaaaagatactcaacatacaatttttaagacttttacactcttgtaatattgacacacaaatctcacgtgttaatcctgtatctgaacaatcagatgctcttttaatcaattcatcatattttccaaatacaatattagacaatccacctaacgatataacttgattattcaatgattgctgtaatctagacagtccaattgaatccccatcatctaaacatattaactgtccaactaatgctttaacatcctgttgtgttttattacatgtatactcaaatactgtactttctggtaccacttctcctcctggttgagtaggcttcccatccacattccatggattatccaaagaagcaaaacttactaacaatttttctgatgtctctcgtatacttgcacataatatattttcttgagtaagctgctgatttgctacgtcatgcaaaagctttatacaattttttaacactgctaaatcttgtgacttatcgctcagagattctttcttagattctaaaatttcacccacttcaaatacatttgtcaaattggcgtgacattctttgactatatcaaaaatgttctttatcaattctgtagatggtaacgttataccttctcgattatttagtatatcaaaacgttctttatttcgtttagacagttgattatattgatcacataatgctttaacattaattaataattgttttacatcaagtcccttacttccatcacacaatttttttacatcgtgcaatataccttgaaatgtagataatagatcttctgatgtagtttgttcactagtaacttgctgttcacttactgcagatgcacctggtataggataaggtttacttccttctgtctgcgacgctaatgtagatgatagatctcctgatgtagtttgttcactagtaacttgctgttcacttactgcagatgcacctggtataggataaggtttacttccttctgtctgcgacgctaatgtagatgatagatctcctgatgtagtttgttcactagtaacttgctgttcacttactgcagatgcacctggtatagaataaggtttacttccttctgtctgcgatgccaattgagtcaaattcagaccagcagatgataatttttcacgtattttgtgatattttgataactcatccctagatacattagttattaacatttcagcctgttttgatacatccactaacataaaagattgcacatcttcaaccatactatctagatctttgttatatttgtccaatatttcacgataaagatcatgcactagttctggtgctaatgtttcctcagcagctaatccatttaatattgctctataactttgaaacaatgtactatatgtagaacacaatttttttatattatactcattcaaagttttatcttcaggaaataaatacactcccattgattgccttatctgataaaggttatgtctatcatccagcaatttcacttttctatcttctggtataatattttgtggtaaagttaatacaaataactcaaaatttgctatatcttcagacacatttggtataaacaactcaacacgcctttcatagtctggtgtcatatcctctgatattatatcctctgatattatatcctctggtatagtatataattgactcttagctcgtcctctcactggaaatgtttccttctgtttacctttagacagtaatttactacctttcacatcaccatgagcaaacatttgatcatccatgcctacacgagactgcggtgatgataatccctcaactgcaggttgttgtatcggtaaatgcaacttttgagattgagatgcagatggtaatttactacttttcacatcaccatgagcaaacatttgatcatccatgcctacacgagactgcggtgatgataatccctcaactgcaggttgttgtatcggtaaatgcaacttttgagattgagatgcagatggtaatttactacctttcacatcaccatgagcaaacatttgatcatccatgcctacacgagactgcggtgatgataatccctcaactgcaggttgttgtatcggtaaatgcaacttttgagattgagatgcagatggtaatttactacctttcacatcaccatgagcaaacatctgatcatccatacctacacgagactgtggtggcattggtgatattacatctacttgctcatttccaagatgcacatcaaccaaactagatgctgacacatgtgatctagtaccagatccaggagttacagaagatttaggtgtagtactctgttgaacttgacttgtaggtttgatagtatcctgaccttgatctaatgacgctgcagatctcctacgagaaatatcaccaccatgatcatggtcacgatcatggtcacgatcatgatcacgatctctatctaatgaagctactgttttagtatcttgagcacgagattccttatctttccatctaccattctttaaagcagctgctaactctagcccaccaacataaacgtaacatgcatcaaaatttattttttcaccatgcatgccatacttttgtgcatctttagcactaagagatatactaccatcagaatttacaacaacactaacctcctgctttggtgcacctgctggaatattaggtgtccaagataattttagttttacaaatccctcagtaacaacataatttctctttttaccaacactgtgtacatatcctttgtctttattagcaaaattaaaaggaaccattgttaacccacaacttttacacaaagaactagagaatatgtcagtaatttttaactttgcacgtcccatgttagcaaacaatacaccaccagctatatcaaaccctacgtcatcataattcatacctgcttttaacacgacataacgtttgaagtcagatatgcatctagatttaatgtcataatattcattcctaccatctatgagagattgcaaaatatcaactttttgatctggtaatacttcattaagtacttgagaagtagtaatattattcgcaagatcagatggagaaagtcctaatctatttttaacactaagtgaagcatttctagatactaaaaattttacaagttcaatatgatttgctgtcaccatattaggagagaaccgcataaagattaacaatttatgtaaaggtgtattaccatccttatctcttttattaatattagttccggtcgataatacttctgctaccatgtcctttgaaccagtaataacagccttatgcagagatgtatcaccatccatatttatattacttataccaatagctgcatactttgtgcggaggtatttatgtaaatcaacattagaagcctcagcacaatttatcaacatagcattaaaatcacatgaatctgctatcttgtttttgcctaataggtcttctaactttttgaatataggataagcaccaggaatacgtgctacagtttcaacacaattttcaaatcttaaatttctattatcaaataataattcctgtaacaactttggatctgtctcttttaaggtagatataactgtatcaaaaagttctaatactctagtatgatcatcaccaatttttccagaagcaatatcttgacataatttttgcaaagcattatttccatcaccatctgtattagctaaagtatttctaacaataccatcatttaatatttttcttaatcttctataacttagatcaataacaccctggtgtttatcaccattatcacttaaaatatcgttacaaacattatcaaataattcactaaatctatatcgtaaacaaaaattctgctgcagtagattgtgaacatcgtcaatagagtcacattcaagaaatgtaccctgtgctttactaaaccgttgagcagctttctctgatatttcagattgctttgttaaaagctctataaatgtaccaagattattctcttgatcactatatggaaatattaacctttcctgcaatcttttcaataaatcaagcgctgtctcaccatccctatttctatgattaacagaaaaactatcatttcttattaattcacaaaaataataccggattcttgactctgacaatgcttctgtattttctgcaaagaactctgcaaatttatgtaatagagtattaccacggttatcaacaatatttggatttaacatactattagaagttactacagcttctattaaatcaaaattaccagacgacacagcacgttcaataatagatttctcattcgataaagttctaagctgcaatacagaagaactacgacttctactaataatgtcaatatattcagaaagattagccttttgttgtattaaagattctatcttttcctgattatccagtatttcttttttacttctactaacaataatttcattttctgggaacaaatgatcatctaataactcttgattagataacatacttcgatggattgtagacgtatcttctgctggactttgtgatatacccaaagaaggtataaaacgttcattactactatctatatatccaccttcatcatccaaacctagtaaatcctgaccactagatgccctagataatgaacttggagctatatcatcatcagatgaaaccaccactgatggttgacctggtaatgaactagtagcagcaacatactcagctgtgcccgaaaatggaagttttatacttagcgtacttagtgctgcactactactagacctggaagtacctacaccaccagctgcttgactttgtgttgcaccactactagacgatgtagacgctactgctgcctgatctggtgctgtactactactagacctggaagtacctacaccaccagctgctcgactttgtgttgtaccactcctagaggatgtagacgctactgctgcctgatctggtgctgcactactactagatctggaagcacctgcaccaccagctgcttgactttgtgttgcaccactactagacgatgtagacgctactgctgcctgatctggtgctgtactactagacctggaagcacctgcaccaccagctgctcgactttgtgttgtaccactcctagaggatgtagacgctactgctacctgatctggtgctgcactactactagacctggaagcacctgcaccaccagctgcttgactttgtgttgcaccactaccagatacctgtaactcagctgttgacaatgtagaagttcctaacgcatcgccacgatcatcacgtaacatttcttgattacttgcaacttcaaattcatgagataacaagcgtgccttctcttcaggatcagaaacaccttccactacacgcaataaacttttttgctgcgcaatgatatcagatcttttgctgccaccaattctttttaagaatatgctagataatcttttactaccacttaaaaaagcagcatttaaaactcgcttatcatatttcttttgtgataacttctcaagagtcttatccaacctctgcgataatattatattaaaagcttgttcacgtacatctaaactttgtatccgaccattagcagcatattccaatagtccttgtcctgctttatcggaagctgctgccaattttttattgcattttattaaattctcaaattcaaaattaccactagtatctttcattgcactataagcacaaatatgcgctaagttagtcccttgtgatgtttttgaatttacatctccacaaagcaacttaataagttcatacatttcatagttgccagtaaatgcaatatattgaaaaaaagataacccatctgaacttctaacttgattcaccatatctgttatcatgtttttcagagatttattctttgtatctattgcatgtttataagctcttttagctaatgcacataaaaattcaagattctcttcgttaactgaatgaaatatgttattttttttactactagaagaacggataatatcctctacattaaattgattcactacataatcatacaatgctggatatttgtccaaaacatccttggcatgtgctacaatcacacgtaataaattttgactaactactggattacttgatttacatacaatgtcattataatactctaatagagcctcttttaaataactccgtattctaggattaacatcttctctttgtgcaaaatcatatagtgtctcaaaagatttaaaagtacacttgtaattattacttaaatatctagcaagtaccttatataatggtagtttcgtatcatattgctttattaataaagaaggatccctctttataagttcttttaacaaatcaagtctattagataatactgcagaatgaggtaggacactatcatccaatgcaaatgcaggattactctttaaataattacaacatgtttctaatagattaggagaacaaagagctaatcctaaatcactgactcctccatcacaagatgaatcaaaatccctcttctcttcccgaatcaaatactgtaaagcctgaggattattttgtacaataacatctctaacactaaatttttgattatacgaaataccaggcacactctttaataggttgaaagctgacaaggcattagcattacgtacaacatatggtaaaatcttatctgacattttaggatcagtagatttaaaacctagatctgacagaaacaagtatatcatgtctctatcaagatttaatttaggatcaataatctcccgtaatagaccaagtaggtcttgttctgtataataacgtagtaactctgttacacactctttatttccaactttacaagcatatgctaatagactatgtcctgctattttatgttttattaaatttacttgctgtttagataaagacttcccagtatagtacctaatattgaacaattcttttattaaatcaacatcttgactatcaataacatctttaatgaaaacctcattaatcatcaaatctcttgacgacttttcattgcattcaatctcatgaataaagcttacacaaagtttcttataccctctttgagctgccataccaaaaggtgtaattcctttcttattaggttgaagaaatgccttcatcaatacatcttgtgaaaacctttcatcatttataataacttcagctaaggcatattgatcctccgatatcatagtatgaaaaatattattcttatcatcaccatatgctgccattaattctttagcatcaatctcctttataaaatgcttaatcattgacacattgcgttttataacagcagcttgaaatggactaaataaagtagacaacctattcccattcaatggatttttaacatctgcaaaaagactttttattttcctatcctgatttatagctttatatcctttttctaactggatccactgctcaacatttccaagcgccgctactaaagtaaatatactatgccctgtcttgtcatgacttctttcagcatatcttttcacatcctcactaaataactcaacaatctctttcttaaatttttcagcatcatgacttactactgttggtatatatcgtgataaagcaccaaattggcctatattaccctctgctaaagacgatacagcatctctactaccttctccttctccgcttcttgattcggaagttgtgtcaacagccgccgaagctccatatatatgcgttagatcatcacagcacatggttgacactaattcgggattaatccgagcataatattgcatcactacaagattattatagtttcgagcattctctaatattagttttgatattccatactgtgaatcaagttcctgaataatttcttgattactttccaaaatatctataacatcttcgtgattaatttttgcaatgtcactaaaaagtaccatcagatccgctatacatcctaatggatcatgatctaatttagcattacttttaattaattccttatgtactgaaattatatgtttaactaatggaaccttatttaaatctgatgcagcctccaacaaactcttaccatcttttgaataatatataatactaggacagtattttaataatgacttaagcttgtttaattcattattattaactaaatcaaatacaaaatttaccaacttgttattaagtgtatctacactagaattgtaagcactatagtttcctttaacaaaagttcgtgcacgagataccatattaaacaaggtttgaagctgctcaggcaatgattctttaagtacattatcaaacacacgactattgacagataatagatgagcaaatctcattaagtcacgaccatcaatttccgactgcaatatttcattacaaatctcaggggagatatcacttaatcctacactttctgcagaatgtcttaacatacttacaatactagaaactccaagagcatctactactctatgtaagaagtcacaatctcttactttggctatttctttagcaaaaacatctttattagttgacaaaggcaatattcgtttaagtaattcaatatttctagattcaatagcatgtttttctataccaatattaataccaagttcccttaattttacataatatgcatcacattcctctaagctagagaacctcttataggctttacttactctcgaaactaactctggatcatttattgaataaccacaaaactcttctctgtaattattcaacattgcaaaattattatcatttaaattctcaagcagagcatattttagctctcgtaattcccctctcgagatattgttttctatttctgcttgtaatgcttttacaattttttcttttttgaaatattctctttctatcccttgttgccttttttgaaattcccctactgctggcgatgatgctgcctgttcaccagactccatgatcttatccatctcattttgtaaggccaacttttgggacattaatttacataactcttcttgttgtattactaattcctcacttaatctcttcacctgacctactaattcatctgataatgctccatctaacattgttaatgatgatgatcttaagtctaatgattgtaatattatatttcttatttgttcttctaattgcaactcttgacataacattcctgatactggcaattctttcaatattccctgcaatacccctcttttactattttcatttactaattcttgtcctacttgtatctctcctctaatagcatcttccagacacatcttcatatgtaataaagccttctgatgtactattaaaaatctcaactctttccctgataaatttcgtttagaacctgataataacttttgttcttctatgttatttaatctcgcttgcgcttgttctacccttattaacctctcacttaggaacaatactgaccttgttactcgtattaatgcagcaatacattctttttgcttctctaatagttccctctcttgacttgtatgctcttgattgtgtagcttctctattttctctaatacatcttttcgtaatgagagttgattccttaatgctgattcaacgtccaaaccatttcgacattgctttaagcttatttcttgttcagctaattgtttttgaagtgttagcgtatttcgtaacttgtctacaggcacttgtctttgcggtacttctcgtaatgcttttaacgttctttcaatataactattatattcctcctgacctttttttagatttttctgagctacctctacttcttttgctaactgtgactgtagtaagttatccacaaacttgtaagatctagcataatctaacaatgcactctgcgatcttgcccgctgtgtctctagtctttccaattcttcagacaaattgtttatcatgaacacaccagtctcaagtgatgatgatgatcgcacctcatttactactagattacactcttctcttagagattttatataagatgtcatctccattaaatcttctataagcttttttatcctttcaatatccagtaactttcgattttccgctgccacatcatcactaagaaactcttgctccagaattcgtagttcttgttgtaactgtcgttgtttttctccatcttcttctctctcgatttgagatctcagttcttgcatattgtccactttgagctttaaatatgacaataattctgactcttttaaacatgctgctctcaattcaccatatagttgatctctaacagtttcctcccttccttccagactttgcagcttcttttgttgttctattaacccttctacttgtcttttactttgcgctatatcttgtcgtttaatcaaagctcttacatcgggtgatgttggaaaaataccagcaaatcttgttaatacgtgattcaatatttcattgttcccgcacctcgctgctacattaataatagtatcgccatttttagtacgtgctaataggtcacaattctcaaatatttcttctaaatcaatatcaccttttagatcagataaaaatcgagacgctacaagtaaatgaactggtgtctcccctaacttattttcttcagataacacatgacgtagacctaatggtgtacctgaatccggatcttgaatacttgcatacaatacctttaatctatcaagcacaacagtaaagacttctttttgtccaggttcagcagtatagtttttaaaaaggcaatgtaatatattatcaccattactttctttagaacgagcatgataaagtgcatcttgcaaacctaatactagtttgcaacactcagaatcattagaagatatagcataatgtaagacaccacgaccttgaccatcagtaaccttccagttcaccctctgtgaaatctttgtatgacgagttacattaacatctttaaatgcacttaaaaactgctctccagcctttgcagccataagtagtggaaactcaccatttccatcttgagaatttatgctatcactaatacaatactttaaaacttccctaaagatttcaggattaacaggccttttttcaccttcatgcaacttaagtatatattgcaatataccacttccctctatattacaaaatattgcactagatatctcttccttacttgatgactcaaagaaattttttacccgtactatatctccagatttaatagcatcgtataaatcctgttttcccatatcctttaacctaaaatatttacaaaatttattataataatattcaatttaaatatatatattaacttatttatgattaatcataatactactatcacaatatgaataacaaaatattaaatttatcgttactgtattaataaatatattaatttctttataaagtataatacatcatatattaaaataataaaacaaatttatttaatcggagatatattcagtggatctacccacattatattaccatcacttttagcatatatcatattaattctattactcttggcattaataaataaaaaagccggtaaagataataactccatttccataattgcatccccaatagtcatagtctttacaaaaacatcttcctctattatcaatcctgaatcacttatgttattaacatcatatttttctatttcattactatctaatacatatccaaaacatctcatctgtgcttttacagaatttttattatgacgatatttattaattctttcacctttatgtttttgtaatttaccacacaaatgactaacagcatcatctattgcattatatgctgtatctgatgttttagaaatcctaataaattcactcttgacatcactaataccaatggtagaattaaacaggtttccatctttagataagatcatttttatattaactgttgaatcatctataaaaaattttgttgtgtgtttttttatggcttcctcaatgtaatctttaatgttatcagtaatgtcaaagcctctagcagtaataagtatgttcatagctatgttttaaaaattatattaacaattaatacactaaaaccctaaaaatttactatacatcatcatatcactttgatataatacagcgttgtaatcaagtttcatatgtcaatatgttaacaaattctatattttccctaactcaagacaatttaatgtcctatatcaatgaagtgcatgcatttccgattttgtctcctgaagaagaagacaggttagcaagaaattggtatgaaaatgggatcgttgctgacgcacataggttagttactagtcatctaaggctagtagtcaaagttgcattaagctttaaaaattatgaattgcctcttatagagctaataatggaaggaaatatagggctgatgcaggctgtaaaaaagttcaatcccactcttggctttaggttatccacttatgctatttggtggatcaaagcttttattaaggactatattcttaaatcttggtcgtgcattaaaattggtacaacacaagcacaaaggaagttattctttagcttaaggaaaattaagaaaaaactttttaaatataaccacaatattacaaaagaagatataaagctaattgcaaataaatgttcaacttctgaacaagaagtagaacagatgaacaggtattttctctacagagatagatccctgaatgaactagtattctctaatgataatcaaaatggagtcgaattacaagagattataaagtgtgataccccaaaccaagaggatacatatttactaaatgaagagttaaatataaaaaaggctttaatttcacaagctttatcaacactaaatgaaagataccgcgacatattcatcaggcggcgactcatcgaagaaccagatactttagacaaattaagtcaagagtataatatatcaaaagagagagttagacaaatagaaatgcatgcttttactaaagtaaagaattttattatatctgaaagagaaaaactaggtcattgtaatatcaatagttaaataagaatagcatatcgatctaactatacgcttaacataaaaagaaactaatatacattaatcttagaaaaataaaagaagatgttaagagaaataagacagaactcaaactgtaaatacaagcatctatacaaataccctaatgcaataatcgacctaccataccaccaaaactaggataaactaacaaatcttcacttcaacaatatagtccaaattactatataaagaaaaaatctaaggtgaaataatttaatgtgagtttcaaaataaaatcacaaaaaacactttataatagcaccttgaaactactttaattaatatccctgccttgctttaaatcttggatttttcttatttatcacataaatacggccttttctgcgtacaactctacaatccttatcccttacttttgcagacttaagcgacccaataactttcatctctcttccttactcgacaataaaattacgtactcttgtggcggagagagagggattcgaaccctcgatacgggttaaagccgtataacggtttagcaaaccgtcgccttcagcctctcggccatctctccccttaacacttcatatttttacaaaatttatttataaaaatgcagaatgtaacacgtattataaaacttgctaagcaaatttcaataaaattctatttactatcaacgttcaaccaacatattttttcaaaccttctaatacttttttaaatagtaatacaaaaccttccaatgaaaacataaataaactgcttcctcaataccagatcaggtatatataatacatcaaatacaatattaatattactatgacaaaaacttctcaccacagcaaacaaacttttatgcaacaaaaaaaactagatgaatttgactatacaattgatgatattattacaaaatatcaaataaaatttgaaaataaaatggaagatattacatccaattttttaactcattttcaacactctctagaagaggaattaatatcattaattaaaaaaatatattctcataactttcaagaactcaataaataccttgttgaacagttattaaattctaacagcttacaaagcttaaataaatatgagaaagacatcatcactaaaatatttaacaaaatttcttttagtgtattagaaaacttagttttttaacaaaaaccttaacataaaaaaacgttatcaatataacatggagttatatgctagaaagttctatgctgtgtattacacgtaaaattgtacctgtatcctcacctatcaccttatcagaagtaaaatccttcctacgcattaacaataatcaagatgatacattaattaataacttaattactatggcatctgaatatgcacaatggtatatagaaaaatcattaatgaaacaaacatgggaaatttcctgtagtagatatatacctggaaaaatacaattgttatttaatccaataataaaagtgaatcatgtaaaaataatacacacaaatggaagtgaagaattgatagatcaaaaatactatcacgttaacacagtactatcatacatttcatttaataagcatatccatggagatagaatagaaattctatatgaagcaggatatacagacaatgcgttaataccagcacaaattagatatggcatattacatcacgtcgctatatcatataaaaatagagaatcagaaaatattaataatttaacttttataaaaaatatatattcccccttccgtgaactgaagttagttttatgacagatataactaaggaaatattcaattcagttataaaattacttcaatcaaataacaatttaactaatactgtaactgatatatacgacatcatacctaataaagtatcattaccatatatatatgtatatataagtaacttaaaaacattaaatacatttaacagtaacatgttaaaaatacaattatcatgtaaaatctactgctaccaacccaatacactatatgaaatattaaatttaatcaccaattcattagtgaatcacaaatctaatgtatcttattttgaatatgaagttactccagaatacagctacagtacaaatcagcacaatgaaattgcatatgcactattaaattttactattttagcaaaaaaaatttatgtcaatagaattacagattaaggactccaacaactctttttcatctttaaacaatataaaaagcttacgaattagcttacataacaaaaacgaatacattaaaaatatttcgttatcaggatggaaaactgctttggaaaactcaggaaatagatacgtaatattcaaggttcaaggtataatagattattcctctgcaaatcaacttttacaacaatattcttttaacaacgatattatagatcttaaaataatcatcaataaaaaagaagtaatatcagcaaaatgcattattgaattgtatgaaagatactatgagtcaagtaattttgacaatttcaatatggttttaataagctataaaaaagtaatttttaataattattaatataattaatatatatttaaaaacattaataattactaaaacaataatagtgttacaacaacaaaaattaatatataagataatagatagatgtaataactatcaaaaactttgtagaatagaaaaagaaatatctgctctattaaaaataacacaggataaatctttattgaatagcttttccacaataaaacaagtatcttcgaaagaatacttaaaaaaggaaggtaaacaagaagaaatacaggaagaaaatgcagaactagagaataatattagttatagaataaatatatcagacaataatgagaataatgaagagattgaaaatattaaaaatctcatcaagttaaaactcaatatccttatgtcagttattgcacatgaaatggatccagtacgacgtgcaggagaaactgctgcatcaaacagaaaagatgcaaaaaaatttggaagatcaacaaaagattcctcaagtttagcaatagtactacttaaaatgattttaaatcaagtaaaacttatattagaagtcgctactacaaatagtaaagatgaaaatcagaaaattgaaaatcaaaaagatatggatacagaacaaaaattacatctacctaatctaatccagaaagagaatcaacaaggtagaaacagataaaacgtattaatgtcatataattactaatataattaaaatatttaaaaaatatataaaaatataaatataacatctgaattaataaaaggtttatatagacatattaatattataatacctcatatatcaccaatatagaatatgcttttcccacataaattaaaaattaaagcaatataccatcatattgatatatctgataatattaatgaattattatatgcacacaaaaaattaattaaaataaaaaaatatctaaataagacaaaaaaaatatctcaaaatattaatgtatttaatataaaaaaaaatttatatcaagaatctaaaaaaaataattcagtaatctgtataaaaaaagaaattaagaaagaaataaagactctattaatgtcaaccatagctcatgaaatggacccaacacaacgagctggacaaaccataacttcaaacattagaggcgcaaaaaagtttggcagagataataaagctagaaaaaaaactagccatacacacaaatcaaaaagcatgtttttaaaattacttaactttttatttcaccttatcgtgccaatgccttcgtgcatattaaatgctaatctcgttatacaaaactccataacaaatagttcacaatatataacacacaataataattacaaaaaatttaaaactgcttataaaatacaaaaacacacagaacaatgcgtaaccaataaacttcagttacaactttaacttaagaatatactttataagtatagtatacttacacttaataataatacacaatattatagtcattataatattggagaattttatatgttaaaataatcatctttataaaatgtcttataatttcctagatttcctcaaattatgctttaaaacagtatcaccaaataatcaaataataaataattggcatctcaaaatcataacagacagactggaagctaccctcaatggaaaaatcaatcgtttaatcatcaacatgcctccaagatttatcaaatccatatgtgttagcatagcatggccatcatgggtccttggattaaaacctcaaaccagaattatagttgcaagttattctcaaatactcagtgaaaaattatctttagacaaccgatatatactacaatctgaatggtatcaaaaactattcccacatgtaatattatcaaaagaccaaaatactaaacaaaaatttcaaacaatacaaagaggttataggtttgcaacatcaataggaggaagtattacaggagaaggtggagatattttaattattgatgatccaatgaatcctatgcaagcactaagtaaaacttatagacaacgtgtatgccattggtttgaacaatcatttatgactagactaaatgatcgcaaaaacagcagtgttataatagtaatgcacagattacatacagatgatttaactgggtatttattatcaaaaaaaactcataacaaatggcatatactatcactcccaatggtagcagaaaaaaataatattttttactctgttacttcaccatggaaatttaaatatgggaaaaaaacaagaaatattttacatataagaaaagaaggagatcctctatataaaaaatatggaaggaaatatatagaagaattaaaatcagaactcgggtcatacacatttgcagcccaatatcaacaaaatcctattcttttatcaagtggcataataaaatataaatggattcaaagatatacttcttatgataatgaagatagcaatataactcaaagttgggataccgcatcttcttctaataacaaaagtgattacagtgtatgcacaacatggtcttatacaaacaactgcttcttcttgttagaaatatacaaagcaaaactagaatatcaatcattaaaacaagaaataataaatttagcaaatcactggaaacctaatgcaatacttatagaaaaaaaagcaagtggattacaaattattcaagaattaagtaatattagtacaatacctattataggtattattccaacaactaataaaacgaccaggttttataagattattcccatatttgaatctcgaaaaatatttttaccatatgattctccatggcttagtgattttgaacaagaattgctatcatttccaaatacacaaaatgatgatcaaatcgatagtatgacacaatacttacattggattaacaataacattacaaacaatgtcatcatcagagaaatataagttcacaattttcacaatataacctcttatgattaatcgttataattatcaacatctctatatatacagaaaaaaaatatgactaaaataataacatgataaatgcttatatagtaagcacactaaggagagaatatagcattaaaaatacacaccatgctgacattatactatacctattaactatagttgtttttaaggataatatatattgatgttattaatttagtaagttcattacgattgatcacaaaaggtggcataatatatatcacattattaataggacgtatccatatattcaattcaacccctttacttataatatcattcttattaattaatccactctctaactctattatcccagttgcaccttttaccctaatatcagtaacataacttaactgtctaaatatctctaattctgatattaattgattttcaattaaactcacattttgtattaaatcttgattttcaaaaagatctagtgaagcatttgctgcagcacaagctaaagcatttgccataaaagttggaccatgcataaaagcatcatctatattatctgataaaaatgcattataaacctcttctgtagttaaagttgcagccaatgtacaaaatccacctgttaatgcttttcctattaccataatatctggcacaatatctgcttgattacatccaaacatagttccaagtctaccaaaacctgttgccacttcatctgctataaataacatattattatctcgtgcaatctcacaaatcttttttacagtacttgcagaatgaattaacattccacctgctgcttgcaagattggctctaaaattatagcagcaacacggtcctttatagaatatactatatctgtaaaatccttaaattcttcttctgtctgcggtaagcgtaaaatgaattgtaaagggtgatattttttgaacttggtaccatgaattttctcaggatcagatattgacatacaccccattgtatctccatgatatccattaacaaaagatataaaactacacttatttgtatcccccaaattttggtaatattgaactgccattttcatagctacttcaacagcagtggatccagaatctgaaaagaaaactctactcattttctgctttggcgaaattttaacaagtcgagatgccaaaacataactttgttcatgtgctaatccagaaaacataacatgcgataacttagcaacttgattctgaactttttgaacaatatgcgggtgagaatatccatgacatacactccaccagctagatataccatcaagtaattttgtattatcctctaacgttatataacatccactagcagattttacccttaatggtaaaggcgagtttttcatttgcgcataaggcatccatatattttgatacccttcatcaaaccatgtacaaaaatccgcatacataactatttataacaaaggattacactacaaaaattatattataaaaaaatacaacctacaatcatacatatgtcaacaccattattaaacatacactaattattcattacaataaagataaacttacaggaatacagtcaatatcattgaccataaaactctagatttactctatataatattataaaaacataaatagggtaacatatacgtactatataaatcttcacacttatactgaaagtattagtatccaaatgtagtattaacatttattacattttctgccaaataatctacacaaacattataacctgcttagagtcaactagctttcataaaaacgtagacctatatcactttaactttgattacgatccatacaagtattagtatccaaatgtagtatcaatatttattacattttctgccaacaatctacacaaacattataacctactcagagtgagactagctttcataaaagcgtaggcctattattacttcaaccttgattatgacctatacaagtatttatgaaaacataaatagaacatttgtgaatgtctcacttacaaaatttttactgatcagttaaacacattaatgtagtatttccacctaaagctgtagtattaatactcactaccttttctgttaggaatctatgtaaatagtatggtccacctgctttagggccagtacctgataacccttgccctccaaaaggttgtactcctactactgctccgacttgattcctatttacataaacatttccaacattgacactatcaataataacatcaatattactttgtactctactctgtacagcaaatgttaaaccatatcctgtactattaatttcatctaaaattctgtgcaagtctccttttttatagcggattatatgtaatattggaccaaatacttccctctttaactgagatatactttgtatttcatatacacatggagcaaaaaaataacctttttcgcaatcttcccctaacttaactttatataacaattttgcttctcgtgacatcctatcttcatgagctatcaacatttcttgtgacgctttatctatcactggacctatatctgtttttaacaacataggatcacctacaactaaatcttccatagccccacaaatcatttcaatttgtttatctgctacttcctcttgtacaaacaacactcttaatgcagaacatctttgtccagcactcttaaacgctgatgttattacatcattcgtaacttgttctatcaacgcagaagtatcagttatcatagtatttaaaccaccagtttcagctatgaatggaataataccaccttctttttctgcaatagattgattaattattctagctgtctctgttgaaccagtaaatgctacaccacctattttttcattccttaacaatgcttcccctaattctttaccactacctaataacaagtgtagaacttcttttggtactccagcatcatgcaatagtttcactgtttcataagcaataatagaagtttgttcagcaggttttgcaagtacagtatttccagtaaccaatgctgcagcaataggaccaacaaatatcgctaatgggaaattccaaggagatatacacacaaatacacctctgctcctaaagtaaaggtaattatcttcccctacaggaccaggcaactttcttgattgttctaactcttgtcttccaagaactgcataataacgtaaaaagtcaacagcttcccttatctctgcaatagcatcagaaataaccttacctccctctctaatgagtaacattattaattttgccttattctcttctattaaattagctgctttttctaatatagcagcacgagtggaaactggaatattagaccaatctttaaatgcattataagccatatctaaagctgataatgcttgtgcagtatccgtaaataatacttccccaataatatcctcagaatttgttggagaaaatacctctataaaattaccatctaattcttttccacctataattggagctgctttgaatttacaagtttgataatttttcatttcttcattaaaatttgttaaagtaacagaatcagtaatatcaatacccatagaattaagcctctcaggaccaaatatatccttcggcaatggtatactaggatgaggtaaatattctaattctcttgctttttctaatggatcctctatcaactgttccaatgatacattactatcatttaactgattaataaacgaactatttgccccattttccaataacctcctaattaagtacggaagtaaatcttgataacttccaacaggagcataaaccctacatttaacatttgctgctaattcttgtgttacatactcatacaaattagcccccatgccatgcaatctttgaaattcaaatcctggatgatccttatttgccatctctaatatcgcagctaatgtgtaagcattatgtgtagcaaaacatggagaaaaagtatttggcttacttaaaattttgtttgcacacgctaaatatgaaacatcagtatatacttttcttgtaaacactggatagctgcttaaccccaattcttgagcattctttatttcataatcccaatatgcaccttttacaagccttaccatcattttatgatgggatcttactgatatatcttccacaaaatccaatactgaaaatgctctcttctgatatgcctgtacagccaatcctaaaccttcccatccattcaaactgctgtcaaaccgtaacttctcaagtatcattaacgatatttctagcctacttgcttcttctgcatcaacacacacacgaatattatgttcttttgccaatttacatatttgaagtaatttgtctactatctcatctaatactttatctatctgtgaaaactcatatctactatgcaatgcagatatttttactgatatctcatcataatctatcaaatttcctatctcattattaactttagactttcctatgctatccactgctgccatatattcagtaaaatacctttctgcatcttttcttgtttttgcagcttcccctaatatgtcaaatgaatacagttccccttctcttctattgttaagtgcttctgtgatatctcttccttttataaaatgctttcctaaaatacacattgcttgttgcactgcctttctaatgataggctcacccattgttttcaataaattatttatggtaccaaaccatctagtactatcattactatcctttaatacctttccacctataaacaaaccccaagttgctgcatttacaaacatcgatgaagaacttcctatgtgattactccacatactgttccctattttatcttttattaaatcatttattgtacaatcatctggtattcttaacaaagattctgctaaacacataagagctatgccttcttcatttgacaaaccatactcttgcataaaagcatctattatacctaaatttctatctactcttattctttcgattatttgttttgcaacactgtaaatcctaattttagaatcttgtgatatttctgttttttctgtcaaatatcttgtacaactattttcttctatacgatacaacatttgcatacgtctacgtatttcattcggcgtttgtaatgcacttatcatttctcatatctcccattaatacctaatatttgcaacatcagcatattagttaacattagaacatttaatcaaattcattatgaagttaataattaaacacactaataaaaatcaaatattttgtttatcataaatattaataatattctataaaaattcactactttattatttttcaaagagtcacatgaatttctaaaccaactattctaacagaatatataaacaagtaacacacacaataagacatcaatataaacactatataccatactttaaacacattactactataaaaaaacacaaacttttgcatatctttcataataataatattacactaaccttatttaagtaatggttatatgtataataacatttattcaatttaaatacacataacttacaaagtaatacaactaaaaatatacctgctatacttttaattctaaaaattcatgtataaatatactctataatacactttatttcattttaagaacactaaaattaatgtctagcacttattggatattatatagattattcaaacttatttagtcctttactttatagttttactaaaatataacatactataatatccgtctataatgtaaaaattttaatgtttatttagataactacctataatttatcctttatcatatttaatttcagtttaagaatacaaccctttactttccattataaataaagtagcatgcccatatttgagttaacgttagggtttacatgttcaatttgtcacaaaaaagatttctgattactggagcatctggtggtattggaaaagctataactaaaactttatcaaatgcaggagctatcctgtgtatttcaggtactaaagcacctgtattgcaggaaattgcagaacaatactcaagtgcaggtaacatatatactttaccttgtgatttaacaaacgatgaacagattaatagcttaattgacaatgcatgcaaggctatgtctggtattgatggcataatatgcaatgccggcattaccttagataaactcacattacgtacctctgatgaagactggcacaaagttatcaacacaaacttaaccacaacctttaaactaaaccgcaatgcatgtcgtgcaatgttaaaaaacaatcaaggaaggataattaacatatcttcaattatagcatttaccggcaatcctggacaagcaagttactcagcatccaaagctggtatgatagctatgagtaaatccatagcaaaagagtttgcaaaccgcaatataactgtaaattgtatagctccagggtttattgaaacaccaatgacagatgcattatcagaagaacaacgtaacaacattataacacatatcccaatgaagaggataggtacaccagaagaagtagctgctgcagttttatttttagccagcgatgaaagtaaatatattacaggccaaactttacacataaatggtggaatgttaatgtattaatgtggtacaatgctaatacactaatttataaagacacatgtttctttttaaaaaagcaacatataaaaccaaatattatatagcactttgtgctaatactatatactttggggtgttcttattcgcaatttttatacaattaatcagatttccttcaaagcttagcaataaagacctactgttaattaatgtgctaatggttttatcagcacgtattatgctatgtttattatcatcctatgaattaacatgcacacattacacaaatgataacgattccttattatattataaaaaagcagcatacgcagctgaagtaattagtactataatcgcaataataatacaagttattgcagtatctcaagtagcagcaggtaatttagagatagtatcaagtaaaaaaacaacgattcataccaaaggagctgtagactttgcttgtatattaatcaagttattaatagcatcaccactgctagtatattttaattatcgtagaatgaaagatgataaatgtgcagcatacaaaaaagatgcagaaattttattttatctttctataacatcactagttataagttttatagcattcatcggaaaaatcattaatgttttagaacaaacacaatcctttgcactcttcaatacagaaaatcacagcaataatggacctactaacttccctcttggcccaataattagaatatcatgtattgcagctagcataatcatattgacagtaatactcagtatagaatcatccattagctctaaaatgtcagataccacaatagaataccaaggactctctaatgctaatgaattgagtggctaaggagggattcgaacccgcgaccgagagattatgattctcctactctaccactgagctacttagcccctaggtaatcatataacacacgatctacataatttcaacataatttatatagtaattaattagtaaaataatgctttataactaaaatataaaaaatatcaaaatttataaatattaaaataactcaacactacctggttatacatatttacagtaaaaataccttatttctattacaactcatataaataaaaagctttaatgatagcatgcaaaattcttctacatccaagtaaatatatttacatagtaaaaaatatattgtatactcaaatttttactactttaaatcaagacacaaatcctaactcacataatagaaagatataacatgataaaaatcaaggcttcacgttatacaaaaatccatcttatagcaatagcaataattttatcattatggaatgtcttttttataataaagttaatatcaagtattccacaacatatcaaaaatcttatatttccatacactgcaatattatccatatcttcattattactctatggtattaatataatatacaatttaaatattatgttaaaataccatcaaggaaaaatagagctgcaaaaaaaatctctattctcttatttaggagtcataggagaagcaacaagtttactggcacttaacatcatatcaaccattgctattttaattttgccaatgaataaacccatgatcatagctgcctctatatttaatatactatcttcacttttcgttatagaatatgcctccatttttttaaatacagacattaaaaaccacaaacagttaaaaaatacaaataagtccacaaaatatacaacatggtcaataataaactggtctgcagcattaatcatatcaatagcaaatgtaagttttacatttactggttattttataaaacacaatgccaatgatatttttaaaattatattatttacagtatacatatcaattattacttctctaatctttatgagaaatatgcgagaaaatgatccctcaatattactaaatgcacaggtagaacctacaagatttaacacagatgaagaaagggaacatcttctgaaacatgaagaaggaatctcacactacagtaggtaaactcatatcagatctacacagtaaatatttatgtttgcaatcacaatgcatatgcatatccttacctttctagcaaaattactgtatgtattattaattactgataaacaaaatatatattaatgttgtaaaatataaatgctcaatattgataagcagtatacttatattataatgctaaaatatttataatctttaattaatcattaagaacttaaatcaagttcacatacaactggagcatggtcagaaggtgtatccaatcctctaagtttatcatgaataacacaagacaatagcttatctgtagcttgtggtgataataacaagttatctattcttaaacccctattttgctgccatgcacctgctttataattccaccaactaaatttcttttcatagtcattcaatacacgaaaagaatctgtaaaccctaaattcaaaatagatcgaaacttttctctttcagacttatgaaaacataatttaccatccataacttcaggatcatagacatctataggataaggtgctacattataatcgccacctaatattaaaatttcttcttttttaagtaaagataatgcatgttctcttaattgatcaaaaaacccaagtttatattgaaaagcatcagaatcaatactttgtccattaggaacatatatactagcaatacgaattttaatattatgatgtagaactacacactccaaataacgagactcatcacaattataaataaaattctctgaacttaattcgtaacataacttagatttgtaatcagatgaaaaaatacttgtaaccaattccccaactataggataccttgttataatggctactccattcctagccttctgcccatgtacatagcacttatatcctaatgattccacatcaaaaaaaggaaactgttcatctgtacactttatttcttgcaacaacgctatatcaatagcactattaattagccaattacataaatgatccaaccttttcctaatagagttgacattccatgtagctatttttaaagtcattgtgatctctaaaaactacttatcaaattaagttaaatacttaccattaatatcaacaaatctatgagttaaatcacaggtccacacagttgcatcgaaattaccagcattaatatcaacttcgatataaatattttgctcactttttacgtattgattaacagaagctttatcataagtagaactaatttcaccatttactaatattacatgggttcctatttttaatgatacttcatttttattaaagggttccccagctttacctatagccatcattattctaccccaattagcatctccacctgctatagcagttttgacaagcaaagaatttgctactgaaaaacctaattttctagcagcatctactgacgtagcatttttaatattaattgcaataaatttcgtgaccccttctccatcttttacaattaaatgtgccatttccactagcatatcttttaaagcaactttaaagtcatcaagagcttgatcatcaacggaacatacttgcttatgtttagcaagatttgtcgcaaatattaaaactgaatcactagtagatgtatcaccatcaacagtaatattattaaaagatacattaacatactctttcaacaatttctgtaatacatctgacttaatgttagcattggtaaaaacatacgctaacattgttgccatatttggagcaaccatacctgaacctttacatatcccatttatggtaactttttcaccacaaattgatacctcctttgtgaccatctttacaaaggtatcagttgtagtaatactatcagcagcatcttcccaagagcttttaatactacccaacataggatctagtattacagatttaattttttcaaccggcaaaggaatacctataattcctgtagaacaaaaataaacttcttcagtagaacaatcaaacctttctgcacacaaccttgtaatttcttcaacggctttataccctccaacacctacagcaacattggagttaccagaatttacaattaaaacccttgccttaccatgaggaagtatcttcctacaatgttcaacattgctactcgctgtataagatgttgtaaataccccacctacactagtgttatctggcatcttaactattaggagatcaagttcatctacaatgtttttaataccacaagcaaaagaatacaactcaactccatcaacttcaggcataacaggaaaattagttggagcaagaggagaaataagaaatctaattggattatttgaaaaatttttgaccattactactaccaattaatgcttcttaagttatataaagtatatgcatataatgcaagaaagttattgaaaaaaattactaaaacttgcttgtaatattaaactttaaataagcaacttctaaaatcaacttcaacattatcattgcgttttttgtatcaaaaactaatctcaataacatgtatttcaagcacagtaagatctaaattacagtatgaccttaaaatcaacaaatacagtatgagaattcaactgaaaatcctgaaaatgatataccacagtattaccatcttcatcatagatcttatttgtgtcatatttccaataatttttcagatagtcatatccgatacataaattcatttttttactataaagataacataacccaacttcgctttggatgctcataccataatgagtcgcaacattacttctaaatccctgataattcaataaaccagcaataccaactccataacttaagtatactatcaacttattattaataacataatcatatccacaattaataagagtagtaacactattgattttaaatatatcttctattttcgatatataaaccttcttatcaataattctctgtaatatatcaattaaatctattttttcaaaatactctaacttttgtatagcaggttttatatttgcatatcttactttaacttcatagaaaaaattattacttaattgatatccagctgcagtattaatatctatgttaaatcgtttataacccatatattctgacttaaagctatcagaataatttccaacaagattatagcctcctttgagataaaaatgatttgctaaagcatcaaaattaaatgtaacaactgcaaaatatacaataacacatatataatttttcataaagagtaaaaatattaactatatatttgatatataattctctattatcaagtcaacataaaaatcattatgataatttaaacattatcgataaacatataaacaactataccattattcccttactatatacatcacttgtaactgcatgctacctatatattagacatattatcaataagataaataactttcttaagaattagatttaatatatacttacgtattatttatgtgttcccattttaaacataaaaatatacaacgctaaaaattccataataataaataaaaatattctagtgaattgataaaatataataataaagaagttcaatatattataaacaatacttagtacaaatgaataatactaaaaaacaaactctaaaccaaacataagaccgtaagatcctaaaatatagcaacgtttaaagttaatattatctttaggtttcatataaccaataaaatatctatatccaccatacataataatattatttaataactgatactttattccaacaatgctttgcatcattaaattacttttaagatctaaagtttcagtatttttcaaaagtttaccaatgaaattatggagatcaacacctgctccaaaaaaaaatgtaaagtctcttatactaaaaaaattaccaacatcatagtacaaattaaagaaaactttgtatttattattattccaatacaacatctttttttgtaagaccttttccctatcttcatcaactacttctttattattatctatttttttcttagttatatacataaactctagatcagttctaaaattatttaaagaggcactaggacatatataacctaatgtcaaccctgcattataaccagtcacattatttacattaaaatcaaaatctaaatatccatctccagttttaaattccagtatttttttatcatacccataagatccaccaacataaaacttgctaacagaatcacttaccatactttttgcaaatactttactgtgtgttaaacaaattaatactaagagtataatctgtagatacaagatagctttcattaatataactacattcttaccaataaattatgtataatataaaatattatttgcattgtaatttaatcaacatttaataagagatcaaatcttatattattgcactattactaatcaatcagtaattaagttgtcaccccaatcaaaatacaataaaatctagtctttaattaatatttccattatctatgaaaaaaatagtattagcttattcagggggattagatacctcagttatattaaaatggctccaagaaaattataattgtgaagtagtagtatttactgcagatttaggtcaaaatgatgatatgtctgcaataagacaaaaggcagctgcatcaaatgtaaaagaaatttttatagaagacttaaaagaagaatttgtaaaagatttcgtattccccatgtttagagcaaatactgtatatgaaggatattacttattgggaacatctatagcaaggccattaatagctaaacgacaaattgaaatagctcaccttacaggagcagatgctgtagcacatggagcaactggaaaaggaaatgaccagattagatttgaatttggatattattcatgcgatccaaatataaaggtaatagcaccttggcgtcagtgggaattgacttcaagaaatagtttaatagaatatgcaaaaaagcatggtattgatgttcctttagataaagcaagtgaaccaccatattctatagatgcaaacctattacatacctcatacgaaggcaaatctttagaagatccatatattgaacctgattatacaatgctctccaaatcagtaattccagaattagctagtgatactccagaatatatagaaatttcctttaaaaacggagatccacatgcaataaataatgtacccctttcacctgcaaatctattacaacaattgaatataataggtggtagacatggtataggaattattgacatagtagaaaatcgctatataggcataaaatcaagaggagtatacgaaactcctggaggaacaattcttttacacgcacaccgtgctatagaaagtataactttagacagagaagcagcacaccttaaggatgaaataatgccaagatatgctaaactaatatataatggatattggtggactactgaaagaaagatgttacaagcacttattgataaatcacaagacaaagtaaatggagtagtacgcttaaaattatacaaaggatctgttatggttgtaggacgaacatcagaaaatagcttatattcacataacctagcaagctttgactcatcaggaaattataatcatacagacgcagaaggatttattaaaataaattctctaagattaagaaatagctaacattttactttaatattgtacctttaaaataacaatattcatcttaagtagcattaagtccaaatcaaagtattatcactaatatatttaccctaagatttggacttattcttataatacgaaatgaaatttgcactattagcaatgtcacacatttcactactgcaaattaattacaatagaaaaattgctatactaataaaactgttatttaaatttaattaatatcactaactcaaatcaacctttcacaattagtaaaagtaccgctaaataacatttacctgcttgctaaataatgaaaataggaaaattataattaacaacacctattattatctaattctcccctattcacattaataggatctacttctaataatgttgcacacaattcttcacatccttcttgaccaagtaatgttgctgtttctgactctagtgtattactggatttattcgctacaggatcatgacttggtacaaaaacttgtgataggaaaatagaggttaaaataactgcatacccaataaagagagcagctttcaaaagcatagcaagatcatgattagcagaaaagtctaaaacctcatgtaataacgtttcatataaaagattataaattcccaacgaaacaaagattacactattcaataatgaccacacagcatgcaaccttattctaacactattgcactgttttgatctagcattgccttcaatacttttcatcaaaagtatagacccatatgttacagaaaatagtgatgctacaatattaaaaagacgaagaggaagagctatagaactaaaaggtaataagtgacttcctaaaattagtaatatagaagctatacctaaaaatcccgtagactcaccaataaaaccacatgctacagctatttgtttcctagcatcacttaatgcactattgtccttctttgattgttccgacagctctcgccttacattaataatattcaatatattacatgtaatattaataaattgtgagataaatcacatagctgcaactattagcaaaaggtaacttgctaaaaattgtatattattagatccatacaacatgataaaaaatgcactagtcaataatattaagtaggaaactgacaatacaatatatgccatttgccacttatgaattttacgcttattaaacaacctattttttttatgactattatctctcataaaccctctaataacacacatatatattaatcatgagggtacagaactattttgtaaagtaaatatttttattattattttaatataattttaacgtaagagtagaaactttatataataatcagcgcataaataccttatggcaagtacctcaaaactgtcacctactgacggcaatacttcacctacacatagtaactttctatgatattacgaaacaaacaacaactcacagatttcatgaaaaagttgcggggaccggatttgaaccgagcgacctacaggttatgagcctgtcgagctaccagactgctctaccccgcatattaatatgccataaatttcagatcaaatatttactatactaaattatttgctctggcaagaactttttttcacatcagcaccttgacttgtactaggagatactgcttgagcacctatatcttcagatgtaataggaggtagtccctgaacaatatctgtaatttcctcacttaattcttgtagctgttcttctgaagccttatgttgtccttcacccttatcaaatattccactaagaaataatgattcacttgaagatgacaatcctctagaagataacgatgataaaccactgctgcttaaactcgatatttcctccacagaggaagatacagatacggtatcggtctcaaaaccactctccttcgctgatgcacctagagatacagtaggactcattgttattgtattcagttcaggagaataagatggaagtctatgcaacacagatttttgcgacttactgctatcaacaccttcttctacaccatctaatgttttataaacaggaacactaggaataaactcctgaaacggagatgatccctgaacctgttcactctgtatttccttttctgataatgattcactactactagagactccctgaaactttccactttgtatcccctcttgtaatgatttaggactactaaaatcgggtccatgtagaccatgaactgcagcttttgcttcatattttagtagggtcttgtatacagaacgtcctaagaccttatctaatattgttttaggctttttaagatgactttccccttcaacacatcctgataataatttaccatccaaactaggtatcgttaatgtgtcgcaactacatgctttaatcaattttttggaatatgtactatcccctgatacagcataatgcacaggagttttcccttcgtcatttcgaacattaactgtacttgacaaagattctttatccaaaccatttaacattaaatcaactacttcattcaaaccttgctgaatggtctgtaagccttcagcaccaggtctcagagctaaatgcaatgctgtattaccgtacaaattttgcacacctattacagcacttaaatcccttttatcacaaccttctaatattattcgcgcacatttaccatcataattcttcagtgcacaatgcaaaggtgtatcaccattgttatttggtgtacatgctaaagcctctagcacatctttatttaaattacttactaataattttactaaatctggattacctgaattaacagctacatgtaataacgtctctcctgcatcattttttgctcccgcaatctttgagaaatcttttttgtccaaagcagatatcatagcagatgctatcttagtaccagataacttaagagctaaatgcagcggtgtatcaccattactattttgttttgagagaatatccctggcagttcttccacctttagatattagcgtttttacacccttttcagcaaaacctttttcttgatggttaacaagcatatgacatgctgtattaccatctcttcctacggcagtagcattacatcctttagaagataacaattccagcataacaagatcagtgttttccacagcaatcattaacaaactatttttataatgaatactgttctcatcagagactttttgattaatatctccaccactagcaaccagtttcttaacagcatgagtattaccagacactacagcagaaactaatggagatgctttaccttctacattaatcctttcaccttgttccagtaataaatctaataatttgttatacccagaatttatacacttttgtaaaagtatatttttatcctcactttgaccaatttttgcaccactatttaataaaagcttaactataggaacaagttttttttcattttgtcctgaatatatagcactagatatcacagaacggccgttattatccacagtattaacatctgctccagcattacatagagcttttacagttttcaaatctcctttttccatcgcagaatgcgcagacgttttaccatcagcatttctaacattaagatcaatagaaggatgggacaataatctcttaataagactatggttacctctattaattgcatattgcaacacagtattttgatcgggtcccatagtttgattaacattcacactttcatgttcaaccatcctttttattatactaccatcacctcggatacatgctagatgtaatggagtaagtgtactatcactctgagcattaacttcttctcctgaagcgttctcaataatcaattttacagttttaacatctgcaaataaagcagccatatgaacaggattgaatccattaggggacgattgtctgaggatatctggagatttttttaaaaataaattaagcaattgtagattattcgctttaacagcagcatgcactggagaagtaggaaaattttgtgaattcagataaccatataagtctccacttacacctgataatatactctgcgaaccaaaaccagacacatttaacctaggcccacttccttctcttattaataattcttgcaaaacttgtttcccatggtgcttttttatagattgccttacggtttcaaatgccttggtaccttcaactttacaagcaatatgcaaaggtgtatcaccttgcaaatcttcacataataatgatgcagcagaacttttaacaccttgaacacgtcctttaactgaacataaattttttatcgattttatatcattaccagcaacagcataatgtaaaggtgtactataattcttatcacgtacagcacaatctacaccattttgtaataacatcacagataacccttttgaattaccgctgattgccgcacaatgcaatggagtacgtccatttacatcttgtgtattaactgcactagcttgaggagactcagcttttgtatttctgattacatatgatagcacctcagaagaagcagcttcagcagcataatgtataggcatcctaccagtaggatgatctataagattaaaatccataccacattcattagcaacctgtatgttccctatagaacagccagggttctgaaccataacatgcaatggggattgatttccaaaatttctaatattaattatattactatttgtcttagatatacaattatccaatacttgaccattacaatttttagcagcatggtgcaatggtaaatttccatcagcatcctgaatattataaccatcaagaccactctcgccgaatgaattctctacactttctatagcgttaatgatccttggatcaacattatatgcataagctaaatgcagtaatgtcattacatttctaccttcacggacaggattattaggaatatcaacttgcactggctcattaattagttcagatatcccttccttatcattttttaaaatactaacaatttcttctagatctggctcaggtaaatttccttcagattgtactattttatcacaaatatgacgcattaacccatcagttactagaaatttaggatctatctcttcatcatgaataactgcatccctaacaccttcccacataacatcgtcaaactccatagcgtacgaaccatcattaaagccatatggtccattcactaactgtctgtcccctatactaggaccttgatatcccgcttgatctaactgttgaccaccttgaccaagtccttggaagtcagcaggatcttgatatatatcttcttcaagttcttcacctgcttcttgaggtacagggttttcctgaattccatctgcacctgcaccttgtgaaacttgatcaagactcgcatatggatcttcttccatttcttcctgatgcccgggtattccctgatatataggatcttcctgaggctcaacttcacccacattgtttcttggcggaagtggaggagcaatttcttcctcttcttcaacagaaggatcttcttctaatacttgagtaggagcaggtctttgacctttaggtaaaggtaccgcatacaatggatcttcttcaactgcttcctgaagctcagctacatcccctcttggcggaagtggaggagcaatttcttcttcttcaacagaaggatcttcttctaatacttgagtaggagtaggtctctgatctttaggtaaaggtaccgcatacaaaccttcttctacagtttctcctgtttcttgctgagaaggcaaatcagcaacatctaatccaccaacagcaccttcttctactggttgggctagcggtggttgaccttcaacatgttgttgatcttctccaccaggctgaggattaacctgatctgaactttgaatattatcctcttgcgaattaggattttgttgtaaattatcttgttttggatctgccataaaaacttcctatacaaactatttagattatccttgcaaattattacaaataataaatttccaaccatttaaacaatcaacataaggctatgcatatttaaatacattaaagtggtttcaataatccgcagtcataggatatcaacaatacttaaaaaaataattaatatagacttgtatgacatctatcccacgatcaatactactaaaataccaatatttcatacgttgtatcaaagatttttctatgctcttgaatagcaaaacgatctgtcatgcctaagataaaatcacaaatacacaattgatcgatctattaaattagcatccatcgcttttacaccccaatcagaaggtaaaatctgtggatcatcataaaaaacttgaaataattccttggatatcaacaataattaaaaaaataattaatatagacttgtatgataatactacgatcaatgctactaaaatactaacatttcatacgttgtatcaaagatttttctatgctcttgaatagcaaaacgatctgtcatgcctgagataaaatcacaaatacataattgatcgatctattaaattagcatccatcgcttttacaccccaatcagaaggtaaaatctgtggatcattataaaaaacttgaaataattctttgaatatcaacaatacttaaaaaaataattaatatagatttgtataacatctatactacgatcaatactactaaaataccaacatctcgtacgttgtatcaaagatttttctatgctcttgaatagcaaaacgatctgtcatgcctgagataaaatcacaaattacaattgatcgatctattaaattagcatccattgctttcacaccccaatcagaaggtaaaatctgtggatcatcataaaaaacttgaaataattcttttattatacgctttactttattttttacccttttcactttatagtagttgtataatttagttctaagaaagttttgtaagcctattttatactgattcatttcttcagaaaaatgtacaaatactttacctaacttcctaatatcatcatgagaacgtatatcatactctttaatattgtttgtaacctgagatattatatccattaacataatatcaacagttcttcttagaaactcatgcacaattcgattatcagatacacttaatccagagttatcatctattactttctttaagatgtccccaatcaatggtaattctaataattcctctataaccaaaatttttgctcttattccatcatcaatatcatgcatattataagctatatcatcagagatagatgcaatttgagcttcagcactagaaaaattgtcaaggtctaacttataatatgaatcataatctaacataaacttatgtatttttttattagaattaattcgattttcccctgtaataggaccattatgtttagctactccttccaatgtttcccaagtaaggttcatgccatcaaattttatatatcttttttctaaaaatgttaatatcctcagagcctgaatattatgatcaaatcctaaatgatgcatagtcatctcatttaaagcatcttctcctgcatgcccaaatggaggatgacccaaatcatgtgctaaagatatagcttctgttaaatcttcattaaatctcagctttctacttaatgaccttgctatttgagcaacttcaagactatgagttagtcttgttctataataatcattttcataattaataaatacttgtgttttatactgtaatttacggaatgcacccgaatatataatgcggtcacgatccctttgataacagtcgcaatattggtcttcctcttcatgaaatattctacctcttgtttcagtaggattacatgcatattttactagatctaacatagttataatttgacacaaataaaaagtatgatatactcactcgttagtttttaattcggtattgcatatatgtcaaacttaaagagtgcagacttaacccttacagaaaatgctgttaataaaattaaacatttaattgatcaagaagaagatgcagattctcttttatgcctatccgtttctggtggtggatgttcaggatttcagtataacttcaacatttgcaatataaatacattacttgctgatgacgaagatgatgaagacgacgattatgactttcttgacgatgatgatgaagaatacgatgacgaagatgagttagagggaggaagcagtgcaaagtttaccgtttttgatgaagagaccggaaagcctctattactaatagatcaagcatctaataatcttttaaagcactctataatagattatgttgaagatattaatgggtcaagatttataatcaacaacccaattgcaaaatctaagtgtggatgtggtaatagtttctctatataagtcatggtataactttgaaaaaatattactctttcataaggcttttttcaactgtatttcttgccttagttgtagctctattgctgcgggtctttttatttgaaccattccacataccttccggttcaatgaaaagtacattgttagtaggtgactatatatttatcagtaagtatagctatggttatagcaagcattctattcccttttcactaccaataataaaaggtcgcattttttctaaactaccaaaagctggtgatgttgttgtatttcgtccacctaaagagatgaatcttcattatatcaaaagagtcattggagtacctggagataaaatacagctcattgatgggtttttgtatattaatggagaaaaaatgaagtatgaaaagctgggtgattttgttgatgatgacggaaaggtaattagccgctattcagaaactctatataatggaaatactcatgaaatattagacgaagttccaggtagcccacttgacaacactcctgtatatcatgtacctgaagggtatgtttttgtactaggagataatagggataattcccgagatagcaggtttattacagatgttggatacatccctcttgaaaacatcgtaggtaaagctcatgtggtagcactgtcatttaaaaagtctgatactgttttaccttttgcaataaggttagatagaatatggcatactattaattaggcctatttatgatttataagaaaaatttttcaaagttatcacctatcacaaatttgatacgtagtgctcttcttaactgtaggggtatgtacattactttacgttatatgtttaagccaaaagttactttaaactatccattagaaaaaggtcccttaagtacaaggtttagaggagaacatgcattacgcaagtataaaaatggagaagaacgttgtatagcatgcaaattgtgtgaagctatatgtccagctcaagcaatcacaattgaagctcaagaacgagatgatggtagtcgccgtacagtacgctatgatatagacatgacaaaatgcatatattgcggtttctgccaagaagcatgccctgtagatgcaatagtagaaggtccaaattttgaatatgcaacagaaacaagagaggagcttatgtacaacaaaagtaaattactccataatggacaaatatgggaagaagccattgatttaaggatcaaaaagaatagccaattttattaataaaatcaaatttttaagtatatataatcatcttctacattaaaaattctgtcaattattacgatatacttttaaaatcagttataacgttttatatttttttgtcattagtgtatcatacaagtaaatcatttctaatttttagaactcttttataatttaaatacacactattcaataactcaattatattttgatcatgacaagatgatataatacttatatcagacttaattttcttacgtttacaatttaataggtctagtaattctttttctatacactggagatctttcactgttgaaaaatctaattgttttaaatactcaatttgtatatcaagaatatttactatctgtgattttatttcaattatatcattcaatataaacactaaaaccccctaaatatggatgcattccatattcctatagaagattagttactataaatctctaccttttttcttaataataaaataccaagatacttagttaataaaaactcaacctttatcaaatatccaaaattatatgatttttaaatacttaacctaaactagaccatattcttactagcacgggaagcacgtttacgttcattaggatctaaatattttttacgcaaacggatagatttaggtgtacattcaactaattcatcatcattaataaatgctatcatttcttctaaagtcattacttttggtggaactaacctaactgcttcatctgaacctgctgctcttatattagttaattgtttaccctttaatacattaacatcaatatcattttcacgattatgaagcccaacaatcattccacaatatactttatcttgaggtttaacaaacataataccccgatcttgcaaattaaatattgcataagctactgcatcacctttatcagtagaaataagaactccattatttctagtaggaatattacctttatgtggagcataactatggaataaccggttcataattccagtaccatgagagtctgttaaaaattctccctgataccctataagaccacgtgaaggaactaaaaatatcattctcactctatcttttccagatggacgtaaatctcgcatatcacctttacggaaacttaatttttccataatcacaccgctgtatgcttcatctacatctataacaacttcttctataggttctaaaacttgaccttgatcatctttacgtaataaaacacgaggtctagatacagatagttcaaaaccttcccttctcatagtctcaattaacactccaagctgtagttctcctcttccaccaacctcatatgcatcaccctgctctgtctctttaactgtaattgcaacgtttgtttcagcttcagctacaaggcgtgctttaataacagtcgatgtcaattttactccttccgtaccagcaaatggcgagtcattcacactaatagttactgccatagttggaggatcaacaggtgttgatgtaataggaaaattaatagaactatcaagaatactatcagatacagaagccttctcaagacctgcaacagcaataatatccccagcttttgcctctttaattgggatacgctttacccctgaaaatgccaaaagctttgtaagtttaccatattcaacaacttcaccagataaattcaatactttaacactgtcattaacccgtattgtacctgtatatatttttcccgttaatattctacctaaaaatttgtccgactctaataaagtcaacaacatagtaaatggtgcattagcatcataagaaacaggctttacatattcaacaatcgcttcaaataatggtactaaactttccctattatcagacaaatttttaacacaccatccatttcttcctgatgcatataatattggaaaatccaattgctcactagtagcatccagattgataaataactcatacacttcatctagtacttcatctactctactatctggcctatcaactttatttataatcactattggtaataatccagctttcaatgcttttgataagacaaacttagtctgaggcataggaccctctgacgcatcaacaagcagtaacactccatctgccattgacaatactctttctacctctccaccaaaatccgcatgtcctggagtatcaattatattaattttcttaccttgccaaataacagatgtacactttgctaaaatggtaataccacgttcacgttccaaatcattattatccatcaccctttcagctacatcttgattttctctaaatgtaccactctgttttaacataccatctaatagcgttgttttcccatgatcaacatgagcaataattgctaaattacatatcgactgataatcaccttgtgacaacataatatctcttaaactttaaaactctatatattaacttatagcacacatgttactaatcaacaaacactgatttaacaattattgatacctatcttacttaaataaaaactatagtactacattttagaaatgaaacataatataccaacaaaagcatctcataacatataactaatagacacacatgttgttatacacacaactttccatattgaaattacactttttcattttatcatctaataaaaataaaactactaatacgagtaacctttatctctaaattgcaataaaattaatttaccatgataactaaaatcatgtagaatgttatcttgctatattactttataaaacctataccaagaatcatctcaacaacaacaaactttgacatgtcttgatataggtagggttttttccaaaaaaatacaaggataccattgatattatacaaaatcatcacctaaaagctttataacttaacataataccattcttagtattattttacctaacagaaatatcttctacacttcttctcttaatttacctacaccacctttgtagatatctgtgatcaaactcattagatattaacatcctatatatacactatttattcatgtgactttgtataatattaaggtcacgttcaattccagcaacagaaatatccattaactctgtcattacttcagcacgcactctatatcgctgctctctctcttctctttcttgtgccctagcatgttcttcctctacaaaaccctgactgtttactgcgctttgaagatcataatcccatgctaatacttgacgcatctctggtctttgtcttcgggtatcatcctgttttgtacttcttggaatacaactttgacaacatgaagaatcattttgtgtattatcctgttttgtgcttcttggaatacaactttgacaacatgaagaatcatcaggtttttgtttggatactacaaagtctaaatctaatcctgaaaaatattccaagtcacggcattcattaaatgcacaatcataaggacctccaggtattctacctaatacaaggtctccataataaccaaggttaccacaagtaaacactttaccatctcggtcaacattagaagatacatcttgcctaaattcatcaattttagattcgctaactacaaggtatatatggaaatgtgcagaacgagtgaatggccccagattccgtttacctgtcaaacgacgtaattctggatcatctcttaaaatataagctggtatattaccctttaataaaaatatagtgtctcccgtgttcggaataggtaatttctcatccttatgagtttgagtaacacgcactagtgtcttacctctaggtccagtattacctattacataacacgactttagatttactgcacatattgaaagtttattacataaactcagattataagtcgtccttcctctaatatactgtctgtttagcatatacataaccactataatttaataatattattcctatatatcatattaatattacaaaaactctgcaataccttaaattacggataatattgctatagaatatcacacaacaatatattataaattatagaatactatattattatgatataaacacagttttatgaaaaatcatagaccgtacacccatgtacgtcaaacaattccgtatccaagaaattacagcagttttatattactatgatagatcttatacatataaagcaatatacatttctgtcatgctccctgtactattaattgaccatattatataacttaacatttgaaacatggattaccacctcctgtaggaaaccagagaatcccaggttttctataaagttagaaatattttttcaatattacttatgcttttcaggaaactgagattcaatgccttcaatagaaagacccattaattgtgtcatgacttcggctgctagtttatccttatcttgtccactaccagaactctcagatactacatctgcacctgatacttcttgttgtgctgcagcttgttctacttcagcctgttctacttcaaaatatttcgtaaaatcttcttcagataaaaattttacattacttaaaccaccaatttgtactaagtctctttcttcactaaaatcttcatcatattttgtaccatgacctctaacgattacaatcccaccgtaattaccaagacctacaaaattttttcgacatagtgacatattacttgccgcatgtaacagaaacggatcaaggtttttactatgcaccatatagtatacacttatgttataataagcagttaatataccaggttcacccagtaaacctcttaattcttcatcatcttctactgcagcagccggtaacctacatctaagtaaaaataggttactccttggacctggaagaggtaactttcttcttcgatgagttttagtactctgcactattaactgacctttagaatcagtaatacctattggataaactgcttgtaactgtacacaatcaagagttaataacttttcctgtaacagggtattaaattttattttatcagttaaacatatttcacctaacatacaacataaaattgtctacataatatatttctatattaacttttattatgataaacttcaattaaaaattgtattcattaatataaaaatattctaaccgctgaatatggatttttataagatttattatatttaataaatcagcaaataaaataatttacacaatcccatagtattcaaaatccatttgttacctacactaacacagaatattacaactaatatttattatttatatacagacaatagtatgaaaactcctaccaaatgcagaatcataacatcaacaacttgaatgacgaagtaagacaagtactgtttttattcatattaatcatacgatctttttagttcaacgctgcacaccaggactactacttacattagatataacaacatcttctaattgtgccactactctctccaaacgccgatttgactgatttgattgttgttgcaatacactttgttcttcattactccccgtctctaaatctacaaaatccgagctgttaacaaattctcgctcttcagtcttataacaacaacttcctacactttttgagactaaaaaggttgcatctaaccctacaaaagttgctaaatcttttgtttcatcaaaaacattactatatggtccaccatgtacatgacccaatataatattaccataacaaccaagattattataagatcgcccatttcctaatgatgtttctagaaacactcgagcataaaaccgatttaccctgttttctggtactagaaggtaacactgaaattttagactacgagtaaacattccaaaactacttcccagcaaaccacgcaactctggattgtttaatacttgatcttttgataaactaccttttagtaaaaataaaacagatcctgaagctggaacatgtttataaagtggatctttatgagtcttagaggcatgcactaacattcgctcaccttcagtattacctattacgtaagctgacttcaatcttattccgtaacaagatgacaatgcactacataaagctttattataagtttttctgttttgtacatttctattattaaacacatttaacctattacaattttaacattcccaatatgttatcgcataatagaagcttttcaattattagtagttacgagcatgctaaatacaatccattaatgtaatatattttaaccatgagatcaaaacggcttcatattaacttttataatggattaaggacaaatacagattgaaaatagtaacattttactaaccaataaaaaaaactttaagacaaatctcaactacatactaaaaatacacttaggcaagcataacgaaaacaactagcattactactttagatatcgtctttaagatttgactattttaaaccacataacttgtcatcctactgatcatattaagacaaacctcaactaccatatttaaaaatatacttaggcaagcataacgaaaataactagcattaccattttagatatcgcctttaagacttggctattttagaccacataactcatcatctctactgatcatattttcaaattgaacagagatattctttaaatatgtaatcacttcatctttactaatcatagcttcaagttgtatagaaagatcttctaaatattgaatcatgttatcttttgactcacattcacgactttttagtatccgatgtttagattgctgaaaactaggtaccactcttaaagctccacctactgcacctaaggatgaatcatcactattatctactgattctattaacttctgtacttttttacgtgacaataaacctttctcttcttccaaaagaaaatctgcatttaactgcgcaatattctttaaggcttgatactcattaaaatgtttatcactatctcctccacgtactctaacaaatacaagtttaccataagaacaaaaattaaaaacatccttatatccatcatactctactacttgtttccatatattgtaaaaaaaatctgaaaaacattctgccttagccataaagtataaattgagcttaacatagcgcttcaatattacaggaccacctacaagagacctaagctctcgatcttgcattactacactacgtggtattctacactttattaagaaaagattctttcctagatctacacccacacctaaagaaagattttcttgagttttagtaactctaactaataatttacctctagggccattagtaccaattaaataacactctttgacttgaagctttaaaagagaggttatcttagcacatagaacactattacatgatataagatcttctaaggatttattactaaacatatactaccaccaaacttacctaattttattatgatagtatgtattttttaattaaaataaacaaattatacaaataaagatgatgatttttacacaaacttatactgtaatttttctgtctctaaacttttacactaaatatagttaactactacaacttacaatgctttcattatagtgtattacctgaaactattaatattgaatacagttcattatcctatatctcaaaaatatttataaatatgatttcatctataaaaagcaccattataacattacaaaatcatgttttaccgtccttactgatcaccttctcaagctcaacagaaatattctgtaataccgtaattacttcatttaccattggtggaacttctttcttctttttcggatgtttggctgctataccttcaccaccaactgcacctaattttgactcatcttgcgtaaatattccaccgagtaaatcatctgttggaacttctttcatttccagatgtttgcctactacactttcaccaccaactgcacctaattttgactcaccttgcgtaaatattccaccgagtaaatcatctgttggaacttctttcatttccagatgtttgcctactataccttcaccaccaactgcacctaattctgacccatctatagtagatcgtactatcacttttttcttacttgacagtaaacctttgatttcttgttgtacagtaaaatttgcttttaattgggctacatttgctaaagcttcaaactcatcaaaatctttatcattcgatgcagtacgtactctagcatatacaaactttccataaccacaaaaatttgcaaaacgtttatactttctatagtgtgttttccgccatacattaagaaagaagtctgtagcagatccatcgttaactaaaaagtacatatttacttcaaaagtactagaaaatttggcaataggattaatcgtattccttaacggttcttcctccattacaaaactacttggcattctacacttcattaaaatcagcttatttcctgactgtgtcccaaaaggtatttgctcttgatctacatgagttttagttaccctaacatttaactcaccattagaatcagtcgtacctatgacaaaacatcctgaaacttcaataaatggcaaacttgttacttttttacataataaatcattatattttttttgatcttccaaagacattttactaaacatatactaatctcaatataatacttttacttattatgaattataattaatttatatataaattataaaagcacatctaatatcaagtcaagtatatcaaaacatataatacaacaaaaaattgttattcttacttagaaaccaacgcaaattaatactataataataaaaaatactaatatttttaataatactgactcaattcatccattaatttctttcccatattaatacctgatttttccgcatcacactcattaaagcagcagcttgcaaataccatatttttttcatttgcaagcatacaagacatatgaattgtatcgttattaacgtactgagctagcgctgctaatggcgtatcacaagaaccattaattgtttttaaaaaacttctttcagccattacacaaacgtaagactgatggcaatttaaaaccttaatcttatttattatactatgatcatcaactctgcattgaatacctattgcaccttgtcctactgcacttaacattattttaggacttaatatttctttaattacatcacatctatttattctgattaatccagcttcagccaatactataccatcaaattcaccaacattagcctttaatattctagtgtctatattacctctaacaggaactacttgaagatctggacgcaaataatttaactgtacttttcttctcacagaagatgtacctatggttgcattaagaggaagtgattttatatctttatgcttagatgaaataaaaacatcatatgggctattacgttttaacacacaaggaatgatcaacccctcacaataaaatgctggtatgtcttttactgaatgcacagctaaatctactttccccattaataatgcttcctctatttcctttataaataagctttttccacctatagcactcagaggaacctgattattgatatctccagaagtcttaattttaacaatttgaacactaatttcaggaaaatatctgtttaacagatttttaatttctaatgtctgtgctatcgctaaaatacttcctctcgtcccaattcttatattcataatgaattagcaaaatactcataaaagctcaataataacaaaactatacgccacatgctacagcatttataaacaaatcaaacgaaaacccaatatcaagcttgaatattcaatcaatatagctttatatgcaatccatttatactaacttaagtataacctcctttatcaaaagccctaaaaactaggaactcataaaaatataatctacagtattgataatttagcttgatgctattaaatatatgttaattaataacccttctacttctaagatataatgcctttaatggataagaaataataactagcatacattataaactcacataaatttacaatattacactcagttcccatgctgagaatcattaataaatacatgacagaaggataccgtgttaccttaactcgactttctctataaaaacttcaagataataataaaactgcatgtatcaaattaaataactctgcagaaatatattactccatactgttttctaataaaacatctccggctaaatataatgacccacaaattaaaattgtagactttctattacaatctcctacttctaatattttagaaattgcatctgccaaagtcttagccgcaacagcttttatacctaatgacaatgcagtctgtaatagttctgctgcagtttgagctcttggttcagattttatacaaacactagacaagaattttatataaggttttaaataatttaaaaatacagcactatctttttctctagtcattccaataataatgtacaaatctcctaattcattattctgtatccaacgtgatagcatttcacctccggcaggattatgagccccatctaaaaacaaatcccaaagttgaggcaccattttagataggaaaccagtagtaattttttctaatctagctggccaataagcttcttttaaaccttgaacaatattttcataatctatattatacccaaacttaccagaaagtatactacaagcagctatggcattacctgcatttattatctgatgttctccacgtaatgagggcaatggaaaaagtaactcatcaacactactcttaaaaagcatactatcgcctttcctttcacaaaaccaatcaattccccctcggtataacggaacgtttttcttaattgcatgatattctagaacgttcattattgattcttgatcttgtggggcaataacacaagtaacattctctttcattattccagctttctcaccagctattaattcaacagtattgcctaatgcttctgtatgctctaatgatattgaagtaataatatttaatattgggtgtactacatttgttgcatcaagacgtccaccaacacctgtttctactaatacaatatctgcgtcaacttttgaaaatgctaataatattgctgcagttgtaccttcaaaaaaagtaacagggataccctcactggcttctctacaaatctctataacctcatgtaaatattgatcagatattctttttccagcaaggactactctttcattaaattctactaagtgtggcgaagtgtaaatatgagtttttagacctgcagaattcaaaatataacgtataaacgatatagttgaccccttaccattagttccagcaatatgtatcactggaggtaattttttttcaggattacctagcctatctaataattgtctcattctaccaggaatcatatcacaaaccagatcagccggtgctaaacctataggtttaggccagtggggcatacttaccataccctacctccttaggtaactcaaaaaaaatgattgcataactagatacaagatattatataccctatccaataaatatcaatacccaaacttttaaaaaattagatacccaacaacaaatcttaaattcctaatctattcacagttatttttataattgagtttaatatccatattcatgaaaagacgatataagttacaaatacctgattttcaaaataaacaatagattttcagtgaattactttcagtttatcaagtatatttttaaattaccaaaaatttaattgttttatcgtagataatatggtaatttacagccactcttatctacttactcaaacatgaaaaacattttaaaattatctattgcagaaatgcatgacaacttaaaaaaaagagaattctccgctgtagaattaactaaacttcatattgaagcagttaacaacgaaaaattaaatgcttttataaccaaaacaccagaaattgctttaagtgcagctgaaaaagcagattacatctttacacatcaaaaagaaaatttaactcctttaactggaattccagtgggtataaaagatttattctgtacaaaacacgttagaacaacagcatgttctaacatattaaaaaattttacccctcaatatgattcaactgttactaaacggctacttgacaatggagctgtcatgctaggaaagttaaacatggatgaatttgcgatgggatcatcaaattctaacagttgttttggacatgtaaaaaatccatgggtaagagcagatggtgttgaagttgtacctggaggatcatcaggtggttcaagtgctgctgtagcaggattcttatgtgctggtgctttaggtagtgatacaggtggatcagtacgtcaacctgcagcactatgcgggatagtagggctgaaaccaacatatggaagatgttcaaggtttggtatgatagcatttgctagctctcttgaccaagcaggagtactgacacgtacagtagaagatgcatccttaatgttacagtcaatttgtggatatgatattcaagattcaacttctgctaatatagctgtccctaaattttctgaaagtattacacatacaattaaaggtaaacgtattggcataccaaaggagtatgaattatcgggtaaatatcaagaatatactgaagtttcagaaatgtgggccaagggaatacaatatctcaaggatgaaggagctgaaattatagaaattagtttaccacatacaagttatgcattacctgtatattatattatatgttctgcagaagcatcttctaaccttgcaagatatgatggaataaggtatggagcacgcatatcatctgatgacattaatgagatgtacgagttaacacgtggacataattttggaacagaagtaaaacgcagaatattaattggagcatatgtattatcatcaggatattacgacgcatactataataaagcacagcgtatcagacacttagtaataaatgattttgttgagtcatttaaaaaaattgactacatactgactcctactacccctaaagaagcattcgcaataaacgaacaattagatacattaactatgtatttaaatgatgtattcaccgttccagcaagtttagcaggattacctgctatttccgttccaataggattatcaaaaagtaacttaccactttctttacaagtaataggtaactattacgatgagggaggaattttaaatgtagctagtattatagaaaaacatacaggaaaaattttaaaatagagggtaaccattatggctggtcattcacaatttgcaaatataaaacataggaaaggagctcaagatgcaaaaagagctcaaaaatttacaaaattaatccgggaaattattgtagctgcaaaacaaggattaccagatccagaatttaactctagattaaggtctgcaatcattgcagctaaaaaagaaaatcttcctaaagacagaattgatgctgcaatcaaaagtgcaactggaaatactcaaactgataattacgaagaagtagtatatgaaggttatggtccaggaaatatagcccttatgattcaaactttaactaataatcgcaatagaacagcagctgaattaagacacgctctatcaaaatataatggtaaattgggagaatctggaagtgtaagttttctttttaatcatgtaggagtcatagcatataaagcttcatctatagacagctttgactcattgtttaacaccgctatagaattacacgctttagatgttgaagaaattatacaagatgatactcaagaaaagatatactatgtcatttgtaatgttcaagattttggtaatgtaagagatcaactatttcataaattctctgatgctgagttttctagactattttggaaagcaagtgatactgtaaaaatagaagatgaagaaatacaaaagaaaatttcaaatctaatggatctattagaaaataacgatgatgtacaatatatagacagcaactttactttctattaaaactacaatggtaagattgaattagttaggtgtataagttataatatttttatattgatcttttagtatcactattcaatataatacacgtatatgaatgggtgaaaatgatgcactgtgtgaataagtgttatttttctgcagaactaccacccaacaacggttaatctttctttaacaatttatagcttgcgttcctaatataggttttgtattctataattagttattcgattatggtatttatgttaaagttgttattatgcttatttttgttgtatattttaataaatcgagtaaaatctaacagttaattttttcttatactattatgatcacgaaatcctatgctgatgaagagttagtaagtttaggtaaggctttacagttgattcggggtcatctttgacattgacaatttaacaagtttattagctgaccttagtctgcagtgttctagtacgtccctgtgggatgacaattctttagcacaacgtattctatgtgaacgtgctagaatatctaaaactctaaactcatttacagaattagaggaagagtataattattatactgaactattatccgttataaataatgatacagatgaactactaaatgagttagaagcaggtttagcaaaattaaaagaaaaggttcaaaaaaaagaagttgaatgtctattttctaatgaagcagatcataatgattgctttatagagattcaatctggagctggaggtacagaaagcaatgattggtctagtatgcttttccgaatgtacgtaaggtgggcagaaatataccataattttaaaacagaaattgtccataagctagatggagaagaagtaggagtaaaatctgctactataaaagtaataggagataatgcatacgggtgggcaaaaactgaaagtggcattcacagactagtacgtatctctcctttcaattcaaatgctaaacgtcatactactttctcaagtatattagtttccccagtaattaatgaagatactaatattgaaatcctcgacaaagatttacgaatagatacatacagagcatctggagcaggaggtcaacacgttaataaaacagaaagtgctgtacgtattacacatataccatctggaattgtagtacaatgccaaaacaatagatctcaacatcaaaatttagctgaagcacataatttactaaaaagcagactgtatcaactaaaattacaagagaaagaaaaaaaaatggcagaagaacacaacaaaagatgcaatataggatggggtaatcaaattagatcatatgttatgcatccatatcaaatggtaaaggatatacgcacagggcatgaagtaggtaatgtaaattctgtattagatgggaacttagattcatttatcatatcagcacttacaacaaaaatataattctattgataacacataatctcagcaccattacaatatctaagtactacttcattcacttgtatacaatatactcgacaataacaataaatagattaatagttacaaaatactataactgttgcctaatttttattatattaactactttaaacccaaaaaaaacagaaatcttttctataataattggaatggcatattgtatattaattgccacacctccattattcacaacaagatataaaactcctgtgttcatagcatttaagaacgatagtttctttggcttagcaacttgtgatatttcttctccaacaatattgttccaattaaaaaacagaagtacttcaatcttactaatatgattcttatcacatttatttaatattaacttttcaacagcagaccctatagtcttagggccagatctaaacaacatgttgtctacctcactctactatatggatttagattataaccactaaaacaacatttatttaatattaatttctcaacagcaaactctatagtcttaaggccagatctaaacaacatattgtctacctcattctactatatggattcatactacaaccaccaaaacaacaaacatcaatctcactagttagacttacgtcgtcactactactgtctatttctatatctcttccagtacataaacaggtatcttctataggtccaaagttaacaccatctagtaccacatccgacactactatattgctccaatatatactcataacatattttcttgcaccattaactaactcctgaagagtacaactaggtcctaatgacgcttgcagtaaattgagagcaggagagatatctaaccctattaatttataactagcaaatgtaattattgaatatggatcattacctaatagtgaatctggctcactaccgaagagttgttttacctcctcgaccatatcatgctttccttctgcatttaaaatatttttaagtaacatatttgacctagtctcaggctctatagcatcttgaaattgatgagccgcaagagcaagcatcccagctacaatatcatcttctcttactttatcactaagtagctccaaaaatgatctaccagatgttgtaaaacgattctctagattacgatatgaagatagtctgtcatgtgtctcaaaaaacttatattttattttatcacctagtacaggcaaatcgtcgtcattaggatttaaatccttttcaataatataatcccggaataagcgtactttttgaactagtgttttatctttcaacctatctgcactacttaaaattgatgcagggctaaagtgcagtaaaaaagacaaagctaacctaccgtcaccgctattaacccaagcttctgagtcttgacaatcatcagatggaaatatcaatgtcggactacttggacatgaacgcaatagacctcttaataccacctcatacaaagttatagtatcaccaccatcactagctgtatgagatttatcctcaactttcttatgtaacaggaaatccatatagtctttacttagctgtcgcctataatacgtataatacattagtaggttcccgccttccatttccacatactcaatattcattgatgcatcgtcttggtattgacttcgaaatttctcactatttttattaaatttagttatgcaatataaacctggaccttcaatctgagcagcttgttgattgttaaacaatacagcacatttacgactaccatctacaccaacattaaccgttttttgagaacataatccatattttcgagttacttttaatacaatacttttctctcgttttggtcctaaattcagtatagatgcacgatcatcacactcgattttagaaatctcattaccaaaatttaatctccttactgtgttttcagtcaaggggacaaatactattacttgcttaccttcttcaatagatggtaaagcagcctcaatctttgtataggattgagaacacatcatagctatgtgtacaatagtgacaagcatagcaatagccatcactgccataattaatatagcagccacatttaaatatggatatgacccactaatatcgtttctaaagcgatataataaagctgcagcagcaaaaatcagaaaacatgtgagtaatacactcaaagattgggttttattcattttctaagaccaactaattttaaataggatgtatattatagaattcattacttaattagtgtaacacattacataaaaattgtacagtacattaaaaaaacaatgccttaggttaacaaacttatagcagtattacttaatatgaaatcactaatttatataccagcagctctattaactataaaaataattaacagtatgtatcattatacatgatacattagtaataatattcaatactaaatttatagtaactatattcaatataccctaaagatgcaatataggatgggataatcaaattagatctatgttatgcatccatatcaaatggtaaaggatatacgcacagggcatgaagtgggtaatataaattctgtattagatgggaacttagattcatttatcatatcagcacttacaacaaaaatataattctattgataacacataatctcagcaccattacaatatctaagtactacttcattcacttgtatacaatatactcgacaataacaataaatagattaataattacatactataactgttgcctaatttttattatattaactactttaaacccaaaaaaaacagaaatcttttctataataattggaatggcatattgtatattaattgccacacctccattattcacaacaagatataaaactcctgtgttcatagcatttaagaacgatagtttctttggcttagcaacttgtgatatttcttctccaacaatattgttccaattaaaaaacagaagtacttcaatcttactaatatgattcttatcacatttatttaatattaacttttcaacagcagaccctatagtcttagggccagatctaaacaacatgttgtctatctcactctactatatggatttagattataaccactaaaacaacatttacttaatattaatttctcaacagcaaactctatagtcttaaggccagatctaaacaacatgttgtctacctcattctactatatggattcatactacaaccaccaaaacaacaaacatcaatctcactagttagacttacgtcgtcactactactgtctatttctatatctcttccagtacataaacaggtatcttctataggtccaaagttaacaccatctagtgccatatccggcactactatattgctccaatatatatccataacatattttcttgcaccattaactaactcccgaagagtacaagcaggtcctaatgacggttgcaggaacttgagagcaggagagatacctaaccccattaatttataactagcaaatgtaattattgaatatggatcattacctgatagtgaatctggcccactaccgaagagttgtcttacctcctcggtcatatcatgctttccttctacatttaaaatattcctaaggcacatatttgatctagtctcaggctccgtagcatctcgaaattgatgagccgcaagagcaagcatcccagctacaatatcatctccttgtacttgatcacgaagtagcctaaaaaatgatataccacgtgttgtaaaacgattctctagattacgatatgaagatagtttgtcatgtgtctcaaaaaacttatattttattttatcacctagtacaggcaaatcgtcgtcattaggatttaaatccttttcaataatataatcccggaagaagcgtactttttgaactagtgttttatctttcaacctatctgcactacctaaaattgatgcagggctaaagtgcagtaaaaaagacaaagctaacctaccgtcaccgctattaacccaagcttctgagtcttgacaatcatcagatggaaatatcaatgtcggactacttggacatgaacgcaatagacctcttaataccacctcatacaaagttatagtatcaccaccatcactagctgtatgagatttatcctcaacgttcttatttaacaggaaactcatagagctttcagttagctgtcgcctattatacgtataatacactagtaggtctccagcatgtgttgtttccacatactcaatactcattgatatatcgtcctgtaattcacttcgcaatttctcactatttttattaaacttagttatgcaatataaacctggaccttcaatctgagcagcttgttgattgttaaacaatacagcacatttacgactaccatctacaccaacattaaccgttttttgagaacataatccatattttcgagttacttttaatacaatacttttctctcgttttggtcctaaattcagtatagatgcacgaccatcacactcgattttagaaatctcactaccaaaatttaatctccttactgtgttttcagtcaaggggacaaatactattacttgcttaccttcttcaatagatggtaaagcagcctcaatctttgtataggattgagaacacatcatagctatgtgtacaatagtgacaagcatagcaatagccatcactgccataattaatatagcagccacatttaaatatgggtacccaccaatatcgtttctaaagcgatataataaagctgcagcagcaaaaatcagaaaacatgtgagcaatacactcaaagattgtgttttattcattttctaagaccaactaattttaaaggatgtaatagaattcattacttaattagtgtaatacattacataaaaattgtaaagtacataaaaaacaacactttaggttaataaatttataatagtattacttaatatgaaatcactaatttatataccagtagctctattaactataaaaataattaacagtatgcatcattatacatgatacattagtaataatattcaacactaaatttatataactatattcaaatatacccatgaagatgcaatataggatgggataatcaaattagatctatgttatgcatccatatcaaatggtaaaggatatacgcacagggcatgaagtaggtaatgtaaattctgtattagatgggaacttagattcatttatcatatcagcacttacaacaaaaatataattctattgataacacataatctcagcaccattacaatatctaagtactacttcattcacttgtatacaatatactcgacaataacaataaatagattaatagttacaaaatactataactgttgcctaatttttattatattaactactttaaacccaaaaaaaacagaaatcttttctataataattggaatggcatattgtatattaattgccacacctccattattcacaacaagatataaaactcctgtgttcatagcatttaagaacgatagtttctttggcttagcaacttgtgatatttcttctccaacaatattgttccaattaaaaaacagaagtacttcaatcttactaatatgattcttatcacatttatttaatattaacttttcaacagcagaccctatagtcttagggccagatctaaacaacatgttgtctatctcactctactatatggatttggatcacaaccaccaaaacaacattcatttaatattaatttctcaacagcaaactctatagtcttaaggccagatctaaacaacatgttgtctacgtcatattctactatatggatttggatcacaaccaccaaaacaacattcatttaatattaatttctcaacagcaaactctatagtcttaaggccagatctaaacaacatattgtctacctgactctactatatggatttagattataaccactaaacaacatttactgaatattaatttttcaacagcaaactctatagtcttaaggccagatctaaacaacatattgtctacgtcatattctactatatggatttggatcacaactaccaaaacaacaaacattagccccacttattatacttacgttgtcactactattttccagtgccatatcttgtccagcacataaagagacattttgtgcatttccaaactcaacacagtccaataccatattcggtactactatatttttccaatatatatccataacatagcctcttgctttatcaactaattcctgagcagtacaagtaggtcctaatacacttcccatgagcttgagagcaggagagatctgtaaccctattaatttacaactatcaaatgcaattagtgaatatggatcaccaattaatgtttgatctggattcttaccgaagagttctcgtacttccttaatcatgccatgctttccttgttcagataatataccaacaaagaacatatttgatttagtatcaggagctaaatcattctgaaattgatgagcagcaatagcaagaaccccaggtaaaataccttctttgtcctcttctattttagtacgaagtagagtaaaaaatgaactaccagatgttgtcaaacgatcctctatattattatatgaacttattttctcatgtgtttcaaaaaacttatattttattctctcacatattataggcagatgttcgtcatcaggagttaaatcacattgagaaatatacctctgcagaagttgtactttttcaagtacttctttatctttcaaattctttagagtacttaagattgatgcagggctaaagctcattaaaaaagacaaagctaatttaccatcatctctattaacccaagcttctgagttttcatcacaatcatcagatggaaatattaatgtcgaactacttgggcatgaccgcaatagacctcttaacattacctcatacaaacttatagtatcatcatcatcactagctgtatgagatttatcctcaactttcttacttaataggaaactcgcaaagttttgacctagagttcgcttacaatacctatgccatacttttactttcccgccgtgcacttccacatattcaacagtcaatgatgtatcgctctttaatctatcttgaaataccccactcttttcattaagtttagttacgcaatataaacctggacctttgacattagcagcttgttgatcgttaaataacatagcacatttacgattagtatctacctgaacatcaaccgttctttgagaacacaatccatattttcgagttaatgttaatacaatacctttcccattgccttgtcctaaattcattacagatgcacgagtattacactcgattttaaaaatatcaccaccaccaaaatttaatctacttactgtgtcttcagtcaaaggaacaaatacaagtacttccttaccttctttaatagatggtaaattagactgaatctttgtataggattgagaacacatcatagccatgtgtgcaacaatgacaagcatagcaatcgccataattgccataagtaccataagtaatatagcagccacatgtaaataaggtgtcgtagaaatatcttttctaaagtaatatactaaagctgcagcagtaaaaaacagaaaacatgttagtaataaacataaagattgggttttattcatcttctaagaccaactaatttcaaataggatgtaatagaattcattacttaattagtgtaatacattacataaaaatcgtaaaatacattaaaaaaacaatgctttagattaacaaatttatagtagtattacttaatataaaatcactaatttatataccagcagctctattaactataaaaataattaacagtatgcatcattatacattagtaataatattcaacactaaatttacagtaactatattcaaatatacctataattatcttataattacattaattaccaataacatgttaagtataaaacaaagaatttacataatattatgctaatccataccttatcataaatatcaaatttttactacctttttatactactctacctttaggactatttccatttgctaatttttcaacaaagctacgttttaatgtgtcattagcaatatcactagtaatatcatgaacactatagatacccatagaactagactttgtattagacatactatgacaaccctctttaatatcagcaggatctttcttagaatcagcactacatttatctttagaagcattatcatcactaccgttagcaattattcctgatcttaacctaggatttactttatctaattgtttagaagccaaatcaacataatactttacagtagaatcattatacacatcataatatttataagatttaaaaagactcattaactccaacacatgttcaggacagttctcaatatctttcaaaccatgaagtaatttcataaaaacagaatcctgtgtatgtataaacatagcctctttcaacattttattaaattcatccttattcttaacactaatgtgttcctcccttaccaaggatttcattttatcatgagcgttatttgcatgttgagattttttaaaattcaatttaccaagtaatgatatacatttacgtgcatcactagaatacattgcatacatactaggatgcttacaaataaatctagcagataatatagccaatatcttctcttcttctgtaaacaaagacgacattaactcttgatcaagtgtatcttcattaactacattgttagataacagcttatctaatatattattaaaatttttatcaaattcaggaaataaaacataattactactatcagatgtaaaaaaatttttaggtttctcaacattatgcacagaagcaatagcatctgtaagacttgcatctaaaactttatctgcagtgtttaaagaacgtgatactgtatcatcaaactgttttttagaatgccattctgctattttacttgtaatatgtttaacattactcaccaacagagtagatgcaataaccataaatattttgagggctatcatactaggaataacacttgcaatagatagtgctacaaccactgctagtgctgcaatcacaaaacctattgctattttaactgccattttataagaaattctcatataaattattttattaatttttattaagttttttataaataataatattacttattaataaaaatatattaaatattaaaatttaatttttgtcttttttattgaaatcttaagataatatagttatattttatcaaattagtaaatatataaatattttttaatatataaacacatcacatgttataatttataggaaataataaatctaacattgatataaaaaaagaaactattaaatatacttaacatactttaattctaccaccaataatagtaactttaatatattaggttacaaacaatactgccccatacccatacaatgtattatgatattaatatgctattatcatcatgtgtataagcacagtaatattgaatgcagatggaaagtaatgcctttaattatctgttttttatcggtcaccctatcaaaatttgacacatctttatcaaaatcaaactgcttaattattcttaaattcagattatatactgctagaatatatgattttcatttattacaactttcaaatacgtatacttttccttttactaaagatttgatttgctacaatactgctaatttatcagcactgttttctcatgtgcaatatctacttgagaaatcattttaatgaattctatatttcattagaatatacagtacgctatatagaatatttacaaacaaatccagcagctattacacaaaacaaagaactctccacccaatagacccttccgtttttatcgtaacagcagtttaatctattatctaagactttattgaatatatggctaatctcaaaaaaagttgatgttgttggtagaggtagggattattatagattgatggttactatggcattaatataaggactattatcattgtaattcatcagtaactttaacaatattatctacaacatccttaacagtacaatatcgtagtctacaacttcatccaaaattttagaaacacatgattgtcattcaatagtgattgatcaagaaatagatctacaagttctttatcttctactttttctttgaaaacaccacaatataacacagatgacaagataaccataaatattacactaagcagtacagaaattataatctatccacttttttcgtatcattgatactatacaaactatcaacagcagaaatatactagcactaaaaattactaacacttaaaaataaatcactttcacgtaaatactctatttaactagtatgcaatataaatatatcatatatagtatattttagtataataataaacattatatacttaattattaattattatcgaatatttttcttaaaataatttaataagattacactttagtgttaaacatcacatatacttgaactaacaattttattataaatcaatgaattaataacaatctaatataaaaaacctagtgctcaaaatacagaataacaactctagaaatgccattgaatgaataagatttatctttcagcaatatcaagcaatttgttaacataactctgtaaattgatcatacatactacatatgtatattatgaacaatcccatgttcataccttccactctttttaccgcagtacaattattaaatgctgtagaacattaactctatttttatataaaaacctaagacatataacaatgcactacaataacaatcaactacaactaaaaaactcatagaaatcactgactttcctacttgatccatcaattcaaaaatattttttactactttgacagaataacttcatcaaaatttacagtcagtacacacacatttcccttgaatatttcaattgattaatcaaaaaattgataaaataaaaaaaaatgcttgatgttaacgtaaattatattaaaaaccttaatttggattttattatgtatccaactatcagtaccagtagtcaatgtaaacaaggaacagaggggttaatttatgaaatgtattacaaaataataataataaagaagatgttgcatcaaacattgagaaatttggtgaaaatgctgagaagttatattataaactattgaataacatatgtttttcatatatgattactcattaataataatttacaagtacctaaacagcaatatggatagatatactgcatcctaataacctgttaatcagcatttttataagttatttatataaaaaccctcatttataattttctcacaacaaaatctatttaacttataagcaaataacatttgtaactaacattcctagattagtaaaactctttgaacctaccgaacacaaagtttattataaacaaaattacccttttttacattatcaaaacaaacaccttttataaaaaaacactacaacttcaattgaaatatttcaataaaaccagacctaataatatcataattatatatttttattaaaaattaagaataatttatataaattaatggcttccacgagtcattgcactatttcctaaaacaggcaaaatcgtatgttgataccatttctcaccaatagactcatcattagattcttgggacatatcaatactattagatagatccatctcacacaatggccaatatatactattatgtctacagttaactgtttcagcaattattgtcattaaagatcgataatttctctccaggtaacaaaaattgaaacttttcattctattacatgcagcatctataacatgttgttctactaaggacgaattataaagagaagtatacattaaactcaccaacacaatatcaaaagaactcccaaaagtaactctagaattgtccaatcccgtatctaaatctttgtagtattcattataagaaattaaaaatgaattaatcatttgttggaactcatcctgatccttaaaaacacatatatcatatgaatcataagatattatcatattagcagtacaatatatatctatatctaaacgagccaacattctaatataatcaacaatattttcaggataggaatgcaacaaataaggcaaacaacacacaactctagcgcaacatactatatttctaagtacatccttaagtatatgtttatctaaaccaaattgagatgcatcatcattataccatacctttaatatctgatcctgagtcatgggtaaatcaggacgagtatgtaaaataaacaatcctacatccaatttagcttttaaccttgtatataaaatataatattccgcatctttaaatctattagctgcttctgcttcacactcttcaaaatcagcaagactccaagtaaccttatctactatcctagcataatcataaaaacttgaaaaaacactaaaaagacattcttcctgattcataatcatactcaattctttagaaataaacatcctattataaggaggaccactatatgccatattaatcatcaatctataataatccctaccgctactaacaacatcaactgcatcataatgggttacttctttaaccttttctataacatcctctatagtacctaataatctggtcactttatctgtttcaaaggaagaaactcgtctattattttcaatgacagtctgttcaaaaatttgagagattatctcctgaacattcagcacactacaacaattgtctatcaactcaacctcaaaaccagattttctcatgttacagatacgttcaataataggttcatcatccacagccttaggctcatcatattgtccaattatattagaagctaaatctatttcctgcgtaactacagcatgtgatctatgtccatatatacaataatacttaaaataactcatacagaatatctcttgtaataatttaaacttttgatcattattaaccatcctgtaaaaatcattttcattaccaatttcggatacacagtcatgcatgtattcacgaaatacatttgataaaaatttacatagttcatcctgactagaaaaactatatactttatttcctagtaatcttattattttattagccgaatttagtctttcctgatatggtacttcctctatagataaattatataacatggcaattttatcatatgcactttcagaataagttgcatacaaagcttcatttctaataattaattgtgctgctaatataacaaatgtaaaattctcttctcctaataaatctttcacctttctaatatcaacaggattatgttcaacaaacatgccagcacatattaacttatctaaaatataatcaaaataccctctaaactttggaaaaagaagaacatcacgactaccatgtacaacattgagataatggtttctacaaggataagattccatctcagaaataccatatggctgagatataagcaatttaaggttttgggatatagaacataaattacgatggatagaataatttgcagcataatgctctggtaaaatagttgtactatactcaggaacgtacctatttagtataataggctctggttctacaggtaaaggtgtattctcatctttacgagtcaataatctcttatatacagatttaagtaaaaatatagaacatattaaacaacatgataaaagcgctataaactgattgatagatactttacgcgtaatgtacatatacaataatacaacagaagcacagtatataaacattaagccaataatattaagagccgtaaaagccttacttcgctggaaattcatcataagaatatcttgatatattaataaaatatattaatataataaaacttttatactaaaagtaaataaaaataattactatacattaattatcttttaactatatattaattgtttctaataaatgtatgattttttaccttttatggatattgtaatataataattattataaatagaaatggatgttttaacttacgtaattccaaaaatacacaacatcagtaatcaattaagtaaatcactaattaataaatatatatttttaactaataatatcatttattacatataaacttataacaatcacttactcagattaagtactaagttacaaatctaagattttattaacagaaaatccaatgtgtaaaactcagaattataaaataatataaatggatatttcaaaaaaaaaaaaaaaaaatatatatatatatataataataaataaactttttgttatctcttaaataataaaatacagaatgtccacatacattaaaaacaccatctatttttataatccaatactagcaatttgacttttagtagtataaaaagccagtttattataaactggtttattatgatgattacatctaagatcttacaaaactgtaaacttatgaataacactattaatcattagaaaaactattttttattattaagaatgcttttcaatgaatctctctgccattcccatattcacatcagcagaatctaagtacatactaacaccacgattaaaagaagccataggaaactcaacatcatcactatcaccttgacataaaacttcttgaatagattgaacatcctcaccatcacttaggtcctgatcttgtatatcagaactatcactttctgattgaccgatggcatatgaaaagctatatgcttgcctatgtctcgtttgaaaaaaagtttctttcaaatttgacaacacactacttctttcttccttattatgttggtcagtacaatcagcaatagtgttattatataagatattaacagttctatcaaattttacacccagataattagcacaaagtaatactaagccatacaataaaaagaatacaaacatacaagccataacgcaactcaaatcttgatgttgcatattcacacaacttaatgctaatcctacaactgaagcagttattaccgctatattgcatataagaactactatcctactaacttccatgcaaaaacacctttacaaacacgtatgaatatctcttaatatataattaacttattaataaaaacacgctctaataattttcttaccctaccataaatccctataaagaaaaaaatcattataaagtatacaaaacaacttaaatcactatatcaacacatacaatacaactaataaattatacaacaggttaaattttatatcattaaataccactaatttctaactttgctttgttctttctctaacgttgtcacttcctcaacatcactatcagtaactatttgccctacactttcctctgctatgccttgagcaatattagttttgcctacttcatcgttaataccagaaaaagtcttcattccaacactattacctacagcgtcatcataataagttgtcataccacatactctatgaaattgaggttcttcataataaaaatacacttgttcatccctaggcatttcaacaggtcttacacttgaatcaaaataataatctgtagatagaccagtatctggattataataattaggagaagaattaggttctgatgaaaactttgtcaaataattatttaactgagtatacttttcacttatactttttttataatttgcacataataatgcaagtgtagctataagtataagtacaaacacaccaacataagcctgaccatgacgtaccttacttgtacaacacaatgtcagtcctactattgcaccaacaatagctattaaactactacaatttattattgtatcatgatattttgccataagtattaacctaaaataaataaaaaattaatatacgatttattattttaacctttatattatgctttaagattttcaattatttattaactattataaagattaaccttaatattaactaaaatatataaaaaaataaatattaatttttataaataattttaatataataactaatatattaaattttaactataattcaaacatactattttttatcaagtaatttattttattacttagatatacttatattatttgataattgagctataatctgactatcatccatatacgctccagcattaacagttttttttttgtttagcctcatatctacgacgtaaaacttttctttttctaatcttcacaacacttagataaattattattcaactgcctaacatctttacttttaccactttgatactatcatagtatatgaagccttttcttgtttagttttagcaatctctataacaacatgttacttaacaagattctatcaacaatattttacttaattagtagaagtagtattctctatgcttttaccataatataaacaataaatcctaagttacagaaactcttaaataaactacataatctttatttggttaaaaaattatattaagtattaatatttaataacaacttaattaataaatattaaaaactgattgttcgcatacaaaagatacattatagatcaaaaataaaaaacttaataaatatcaatatttaattataatacctatactactaattaattaaaattaaaaaattaataattgtatttagcaaaaatattacatttttataacaacataaaaaagctaatctattatttttaacgcttgaataaacgcattatgcggaacattaacattccctatagatcgcaatcttttctttcctttcttctgtttttctaataatttcatccttctggtaacatctccaccatataattttgctgtaacatctttacgatacggagaaatagtttcacgagcaacaattcttcctcccactgctgcttgtattgcaattttatattgttgtcttgggattaaatctttcaacctaagacatatttcacgtcctctctgttccactttacttttatgaataatacatgcaagagcatctactggttcagaatttattagaatacttaatttagcaatttcactatccaaatattcatccatttcccaatctaaactagcataacccttagacatagactttattctatcataaaaatcaaacacaacttcagataatggtaatctatattttaacaatgctgtattacctgaatatgacaaatctagtttttcacctcttttattattacataatgacataataacacctaaatattgatcaggtaccataatagtagcacagatccatggctccttaatattagcaatatcttgcgattcaccaaaatcatgaggattatgaactttacgaacatcaccacttctagtagtaacttgatagattacccctggagctgtagcagtcaaatctaaattaaattccctttctaacctttcttgaattacttctaaatgtaacattcctaaaaacccacaacggaatccatatccaagcgcattagaaacctcaatttcaaaagtaaaacttgcatcattgagttgtaactttttcaaagcttcacgtaatctttcaaattctccagcttcatttggaaaaatactacaaaacactacaggatgaatcgtcctaaatccaggaagtggttcactacatcttctctgctcttcagtaattgtatctcccactttacaatcagataattctttaatagatgcagtaataaatccaatttcacctactgaaagttgatccacaactttcttatgcggggtaaaaatacctacattatcaacttgatacacagcattatttgacatcatgacaattttcatgccctttcttataacaccatctttaatacgcaacaaaattactataccaagatatgtatcataccaagtatcaactagtatagcttttaacggattctctgatttcccagatggagctggtaatctagaaacaatagcttctaatacatcttgtataccaatacctgactttgctgacacaagtagtgactcacttgcgtcaataccaatcatatcttctatttgcaactttactttgtctggatctgaagatgctaaatctatcttatttagcactgggataatctcatgattactatctatagccttatatacatttgctaaagtttgtgcttcaactccctgactactatctacaataagtaatgatccctcacaagcagccaaacttctacttacctcatatgaaaaatccacatgtcctggtgtatccattaaatttaagtaataagtttgtccatctttagctttatatgctaatctaacagtttgtgctttaattgtaataccacgttctctttcaatatccatggaatcaagtacttgatccttcatctcccgttcatccaaaccattacattcttctattaaccgatcagctaacgtagacttaccatgatcaatatgagctattatagcaaaatttcttatatgactttcatccatttcaatttatcctcacacctttataacctttacactttacttcccttcaaagtaataatctcaaaagtagcaggaatactaattttatctactgaaaaatattgtttataattctcaaaaatctttgtaataacagttctagttaaaggatatttatttctaacacgtaacacatttccttcacccatattttttaaatccctaaacaaagtatatatatcactatactttaccacaatagtattaacatctactacaatatcagaatatctaattttctgtaataaagaaataatatcttgaacattaatgaacggcaaaactctaggtgcaataccaaaatccatctcagccctgataatcgaatgtttcaattcataaagagttttactaccaaataatgcagcaagaaaaactcccttgctttttatgatattatatatatttaatagtacactaaataaattattaacattatgcaatgatacattgctaataacaagatcaaaaacattattacggaatggtaatgcctcttcatcggctactatcttatacccgccattcacattatataacacacaatatgataaatcacattgaactacttgttccttagaagatattagctttttatgtaataaattttcaacaaaagagttagtcctaacaccaagatttaaagccaatcctgtagcaaccgaaaacaaagcaatcttatctaataaaatatcactaattgcagaaaatataaagtcattatccttattacaagatagcctatccctataaaaccttacaagggcacgatcaaaaataagcatagagatcttctacgtagcaatctaaattaaaaaaacctaggcttcctaggaacatcatgaccatttctactattactgaatgagcgattattattcccaaatccgtttgacgatggtaaatcttctctataatagttaggtccattactgttacgacgtgatgatctactactaccaccactacgttttttttcatgactaccatgtctactatttgggttatagctctccttaaaactactaccaccagtactaccacatgaatcatcagaaaaactatttttccttatattataaagctcaccatctataggttctccactttcctgatctactctgcgcatagataattggatatgttcacgatctataccaattactaacacttttactttatcattcaaagaaataacactacctactgaactaatatgttcattccttatttcactaatatgtactaatcctttcttaccacccaagaagctgacaaaagctccaaacttcataatttcaacaacagtaccttcaaaaaccttacctatctctggttcagttacaatatccattatcatgcttttagcatattctactgcctcattgttaacagcatatatcataacagtgccatcttggattatttcaattttcgcacctgttttttcacatatatcacgtatattttttcctccacttcctattacattacgaatcttatccttatttataaaaatagattctatcctaggagcatgattttttatacgattgcgagattcttgtatcactgcattcattttacttaaaatatgcattctaccatctttagcttgaagtaatgctttttcaattatatcaatgtcaatacccgatattttcatatccatttgtaaagcagtaacaccttcagcagtaccagctactttaaaatccatatcaccaagatgatcttcatcacccaatatatctgaaagtattataaacctatcatcttctttaatgagccccattgcaattccagcaacaggagatttaattggcacacctgtatccattaaagccaaagacgcaccacaaactgtagccattgaagaagaaccatctgactctgtaatttcagaaactactctaatagtatatggaaaatctgacttttcaggtaatacataacgaattgccctccacgcaagcttaccatgacctatttctcttctaccaggagcacgtaaagctgcagactcaccaactgcatacggaggaaaattataatgtaacaaaaaattttctcttctatcaccatctaaatcatcaactatctgctcatcttgaggtgtacctaatgcagtaacaaccaatgcttgcgtgttccctcgagtaaataaagcagaaccatgcgctttaggcaatacatccacttcaatttctatatcacgtatctcatcaaatgcacggccatctattctagaagaggtatcaataattttggatctcactaacgatctttcaaaggtttttaatgcagtaactatatcttgatcactacactccacatcaccagcactatatttatctgccacttcagacaatactttacccctcaattcctccaattttaataccctttctttctttatagtgttagagtatgctaaactaaaatcctctttataagaggactctatatcactcacaagtgaactaatatcatggggtatgaagtcaataggtgtttgaccactttcatgactaaattctttaattaaattaataacctcttgacaatgttgatgcccaaaagttattgcacctaacatctgagattcagataactcagatgcctcggattcaaccatcaaaacagaatcttcattacctgataaaaataaatctaaagaactacagagcatctcatcagcagatgcatttaataaatacttaccttcagatggtaaatagccaacccttgcaccaacaaccaaaccattaaaaggaacaccagatatagataaagctgcagttgctccaactaatgctgtaacctctggaggtgttacagtatcatatgaaagcaaattacacactatactaatctcatcataaaatccagcaggaaataaaggtcttatactcctatcaattaaacgagaaatcaacgtctccctatcagatggtttaccttctctcttcaaaaaaccaccaggaatcttaccaacagcataactcttcgcaacaaactgtacagttaatggtagaaaatctaccggttccttagttttacctgttactactgttgccaaaactgtagtaccggcataactaaccataacggcaccactagcttgtcttgctatctttccactctctaaaactaaggttttccctccccattctgcagatcttcttatcaaattaaacatacattatttcctacttttctataaattaaatcagtgaaaaatatccctgatacctaatcgttttatcaatgctaaatattcactatccccatatttcttcctaacatactgcaatacattacgtcttctacaaaccaataccattaaaccacgtctacaatggaaatcttttttatgaacttttaaatgctcagtcaaattacgtattctctctgataagattgcacattgtacaaaagaagaaccagtatcatcttttttaaggcaatattcacttattaattcagactttctttcacgtgtaattgacataactaaaataccaaatctttaaacattaaaaatacgtactggccttacaacactattaactatactacagattgccactggcacattacccgtactaacataacagataccacaattccttactacatacaagttatttaactcaatattttgaccatttttaatcttttttatctgaatatcagaaaacacatcattaagatgtttcatatcctgcaaaacataccataaaggtaacaaataactacattttctactattattatataacatctttaacatttccaaagtaatggcatttttcttcctaaaacaacctaccctaactctctgtaattttctaacataccccaaacatcctaactctattcctaaatcccttgctatagaacgaacatatacgcctttcttacataataaataaaaatctgctttgttattctcttgatcagcagacaataatttcaattttaacacgttaacatctctagaagttaaacttacatcttgaccatttctcgccaatttaaaagctcttactccattcacatgtactgctgaaaaattaggaggtacttgtcttaacaatccaataaaatttggaatagcttttttaatatcttctgaactaggtactatatcactttttgctactatctttccttctatatcatcagttgttctttgctcaccccattgcactgtaaacaaataagatttcacaacatcaacagcataaggcataacttttgtagcttcaccaatagcaatgggcaacacaccagaagctaaaggatctaatgtacctgcatgaccaacttttttgacatttaaaatttttttaactagattaactgcagaagcagaacttataccacatggcttatctaggtttatccaaccatacatacaattaaaaattcaaatcaacttaataacctacggaaacattatataggcattaaaattacatagttaccattaaataataaaaaccaaaacatctaaatgttataaataatattatagaaaatcaagttattgagtttcttttttcattttaaacattactacacttaattgataatacatacgcatatcacaagtgtaataatcatattatattaatacagcttaagtttgcataaattaatttagaataataagcaattacagtcaattaaaagaaatcattacagtgttatcatatatcaaaatataactcttacaaagattacttaatatttgtaaaatttcatattaacaatatgccaacggtaacttcattatattcaaataacccagttatacataaacattcctttatataattaataaggaaatatcagtaggttatctaaggatattaatttttatattgattatataaaataatatcaaccataaatataaatcatttatacagcaataaatttcacttattaatgaattataattatatctactatcaaaaatttatttacagatcttgaattaaattatatagctataccaatagcacccttagctcagctggatagagtttttgactacggatcaaaaggtcgggcgttcgaatcgctcagggtgcaccagttttttacatcttttgcaattataataatgtgtgagagattacacttatcattttaccacaaatcacctaagagcaactctattaaaccctatagttaagacatttattggtacatccttttatcacatcttcattgttataatttttttatcaattaataactcacttataaaatttctaaactcacactatttttcatttctacgatatgctatgattaaccaattcacaaaataaaaaaactatggctatcatgacaattaatacatcaggtcctatatgttctgttgctataattagtgaaaatcaaactatgtactatgaagaaagtacatctgacaaccaacactcagaatctctatttcaattgattcatacactatttgataaatctaacaattcatataacactataacaaaccttggagtagtagtaggcccaggaagttttactggcattagagttggaatagctgcagctcaaggaatacaccttgcatcaaaaatcactctacatggtatcagcactctagaaatgcaagcatacctgatatacaattcaacaaaaattaatgacggagaaatactatccataattgaaatgtctaacaataaattctattctcaaacttttaataatcaacttattgcaacaaataaaataaaactactagacaaaaactttaactatcatgattttacacaccacatccaatccataacgtcaaaaaattttaacgcaagagttgctgctttgatattggcttataaattacaaaataacttacctacactaaattccacgcctatatactttaatacaataaactaatgttacctagactacatgctaattaaataatgaagcctttatataattatatcaatataactactacaactaccatttactattaaataaaaatctaaaaattactgatatctgtaaatttttttataaaaagtgcctttatgatttccaatgaaaatatttgcatgagattttttgtctgatatattaaacacgtttaatacttatatgcgtatacacatgaaatctaaagcttttttcgtaaaaccgctgcttataattttagtatgttctttagtctttatagcatttggagcatcttttttccctggtagctttaacaacgaaaaatatattgcaaaaatcggacacgaaaaattatcattacaagattatacaagtgcatatcatgatgaattaaggtatatacaacatgtgctcaatcgtccattaacagaggagcaaattgcgcaatttaatattaaactttctacattaaacaagctgattgaaaacaaagtcttaacaaaatttgctgattcactaaatctcaaagtaggagaaaacagcatattaaatcacataaaaagcataaagttctttcaagacgaaaatggaaactttgataaaacaaaatttaacattggattgtcaaatgcagggcttacagaaaggttatacataaacaaattagaaaaagcatttcctataaccatgctcatgagttgtttattcagcggaacacaaaacacttacactcaatatcatccagagttaataaagcaaattttacaaaatctgcatcaagcacgtactatagatgttatagaaatatcccctacaaccaatgacatttctgtcccaaatattgatgagctaaaaaaattgtatgaagaaaaacgcaaaagtggaaatctaacatttccagaaagtagagttatagaatatgtaacaattgaccatgaaaactttattaaccaaacaaatgtaacacaagaagaaatagataataaaataaaagctgacgaattagatgaacaaagagatatatttaatttagtatttagtactaaaaatgaagctgaaactgctttaaaagcattaaatgaaggtacagactttgacagtatagttacaaatattgctcacaccactctagataatataacattgttcaacattgtaaagaatacacttcctaatgatataagaaatcaagtattttccctaaaagaaggagaaataagtcctatattacacagcatgtttggatggcatataataaaaataaaaaatattcacaaaatctccactaaagatctagcagaattaagtgaaaaaattgcccaaaatattaaaaagaaaaaagctactgaccttttatacacagaaatccaggctataaatgataagattaataacggtacatctattcaagaaatagcagaatcatataacttatctataaaaacagcaaatgttgatatctcaggcaaagatccatctgataacaaaattaaaatgttagaaacaaattatgatgcaatcgttttagctgcattttcagctcaattaaacaaaccttccaacttcacagacaatgacggttatttttttagtgtcaatgttactaagatagaaccatcaagagaaaaaacttttgatgaaagtaaggaacaattagtatacgaatggcagcatgatttaaaagctcaaaaattatctaagctaacacaagaggttgtcataaaacttaaatcaggtatagacataaataatattgatggtgtattactaaagccgaaccaagtagtttataggaacagcgttgctgcagtagataatcctggccaaaattatcctagtgatcttataaatgaaatttttcatcttaaaaaaggagaaatcagtaaaaattatcaacatgatatcagttcttcagaacaaaaaatgctaatagcaatattgaaagatataaaaaatgctgatcaagtaagcaacgtagatttcaaaaacattcaggaaaaaattgcaaatgataacttagaatcgctaaaaaatcaactaatagcacatctaataaaaaaatattccgttaaaattaaccaaaatttaattgataatgtgcggtagtctgatctctcacaataaaatgcagcttaagtttgcataaattaatttagaataataagcaattacagtcaattaaaaggaaccattacctatacatatatcaaaatataactcttacgttgagttgtacatacaacgtattatcaatttcattagattataaaaaataacataaactatataacgttgatcgcagagtatttgtaaaaacataaataatgtttcatttttactaatttaataaatgcatcccttacaaaagctatcatataaaacaaactcttaaataagattattaataaactatagacaaaacatttataaaaaataaccctgaacattaaataccatacctgcgtaatgttaaacttactaatactaataacaattactttagcttagttgtaatttaccaagaatcacatgactattcatggtaatatttttatttacaaccttgtttcgcgtaaaacacatgcttacgtatctaacataatttaaaaatgtaatactattgtttagcactctatgataatttaccacacgcatctaaaatacgatcacaagctttagataaatgttcagtagaagtagcataagatattctaaaaaatccttgtgctccaaacgcttcacctggcactacagcaacattgtaatcttctaataagtacttagtaaaatccatagcactatttataaccaaaccattccttgtacttttacctatcaactttttacaagaaataaatacataaaacgcaccttgaggctttttaacagataacaatgaggtattatttaccatatctaccatcatatcacgacgtgccgcaaatattttatttcgttcttttaaaaattcttgatcaccagctaaagcctgtattgatgcaaactgtgcaatactattaggatttgttgtactttgcgattgtataacagaaatcgcactaataactctcgaatcaccagctatataccctattctccatccagtcatggcatacgcttttgagacaccattaattgtaaagactctatcatataagcgtggctcaacttgggcaatagtgaaaaattcaagatcatcatatattatctttgaatatatatcatcagtcattacataaatatttgggtatttcaataaaacttcagcaatactttttaattcttcatatgtatatactaaccctgtaggattattcggagaattcataattaaccacttagttttctcagtaattacagattctaatatatcaggagttaatttaaatgtttcaccacaatcaacaataacaggatttcctccagatatttttaccacatctggataagacacccaatatggggatggtattattacctcatcaccactatttatagtagccataaataaattataaatacattgttttgcaccatttccaacagaaatctgattgacattataaattaaatcatgatcctgtttgaaacgatcaataatcacttttttcaattcaataataccattaactgctgtatatttagttttaccagaattaattgcatcaatagctgcttgcttaatatgctgtggtgtatcaaaatcaggttcaccagcactcaaagaaattacatctactcctgacatttttaatttttgagcttgatttgcaatttcaagtgtaggtgaaggtttgatacaccccattctttcagctataagtgacataattaccctaacatttttatataaacaaatgtattctagtacacttcaactaatattcaatattattgttatccacatcataattatataatgtattaataatatcgaatagcagatattacttcagtattctcaatatgaaataaacttaaaaaataacctaacaacccagtatacaaaacttttgcatcacacatcccttataaataaagatcacgtgataaaacaacacaagagtcctataatttagattgtaaataaaaaattaaatataaatttcatattatatgacaatttatatcataaattataattacaaaactattaaattgtagtattaagtactataacgattgttgctatataattaactaggtaattttatgaatctcataacaaaacaagctattgactttacagcaaaagccgttatgccagatgacaaaatatgtgaatttaatttgaaagaatatgtcagtggcaaatatgctattttgatcttctaccctagagattttacgttcgtatgccctacagaaattatatctctacacaatagaatacctcaatttatagaaaaaaacactgaaattattggtattagtacagactcagagttttgtcatagccattggcgtaacattagcataaacaaaggtggaattgataaaattagtttcccactaatcgcagatgactcacattttatctctaatagctatggggtattgcataacaatagtattgcattaagggcaacctttgtcatcgatgataatttcatagtacgccatcaatcgataaatgaccttcctataggtagaaacgtagatgagcttttaagaataatagatgcaataaaacatcatcaggttcatggagaagtatgcccagctggatggatgaaaggagatccagcaatggaagcatcacaacatggtattgaagattacttaaaatcacacatagatcaccttgaaaaaagtattatggatgaataaatgacacaaacatataatacaaaagttttaattataggatctggagcagcaggttgtactgctgctatatatgctgctcgtgcaaacttaaaacctatattaataactggaatgtgccccgggggacagcttacaattactacagatgttgaaaattttccaggatttgcacatgcagtacaaggtccagatttaatggaacaaatgaaacaacaagctcataactccggagctcagattatatctgacgaaataaaagaaatacattcagatgtatacccttttaaatgtataggaatatttggtgatcagtacattgcagatagtattataattgcaacaggagctcaagcaaaatggctcaacataaaaagcgaagaaacctttaaaggtagaggtgtatctgcatgtgctacatgtgatggaacgtttttcgctggtagtgatattgccgtaataggaggaggtaatacagctgtagaagaagcattatatctaacaagatatgcaacaaaagtatttttaattcatagaagagatactctacgtgctgaacctataatgcaagaacgattattcagtaatgataaaatacaagttatatggaacagcgttgtagaagaaatactaggaaataaggaaagtgggaatgtagaagctatagcattaaagtctgtaaaaactggagacatcactactatttccgtaaaaggagtatttattgctataggacatactccaaacacacaaatactaacaaccaaagataatgggaatatagtagatttagataacgaaggatatatcattactaaacctggtagtacagtaactagtcaccctggaatctttgctgcaggtgatgtacaagataaaatatatagacaagctgttgttgcagcaggatctgggtgtatggctgcattggaagctgccaaatttttatcagagcaataaacccataatctaccgatacaatattaagaattaattacttagtttagcctcttctaaagattcattttttatttcttgaaatccactagcattgtaatcaagtaatacgatttctgctcctaatttttttaacacttcagcaatgttgtttgaaaatgcccattgtaatatacaagaaatagaaatttgttgctactctttcatagaaaaggataattaaatgtttcactttctaacataatacagtagctaaaaagtaaaaatcatgttaaaaattattaaccattaacattagacttttgatagaaatttttcaaacattcttgtacattcacaggcacaaaaacacttacatctccatttaatcgtgctatttctttgacaaaacttgaagaaataaattgagtatcttctgaagctggtaaaaagatagtttcaatctgagaagtaagtttataatttacccaactcatttgaaattcataatcaaaatcagatacagctcttaatcccctaattataacagatgcattattttctttagcaaaatataccaataatccatcaaaaattacagtatttactgccatacctagcaattttatctcatgctgtataagttccgcacgaacttcagcagaaaaaatagttttttttgtacaacttctagcaacacctattactaacttatcaaccaaattataagctcgctttataatatcaatatggccaaaagtaataggatcaaaagtaccaggatatatgcctattttcacagaaaattatcaatgaataaaaatttattatatcacaacatcttaattattttaagcttatatttttacttgaacagataatatttacaatatataatttctgaacttaattaatttacaggcttgtattagcattataaaaattatagttttggcttgatagctcagttggtagagcaaaggactgaaaatccttgtgtcgttggttcaattccaactcaagccactttcggcatattccttatgttcagagtttagtaaagcctttgtggcatgtttgttcatatagcctacaagtcaatagttttacggagactaaatgcgttatttcatactaatattattttttttattttctacatcaacaattgcaatagaaacagcaccaaataaaatggttgtgggatttgtacgtactgcagaagaaacttaccctgaagaatggacattttcaaacaacattgctgaaatgttagaaaaattaggagcagaagtcgtattacttgattacaatgtaatagtagatttcaaaaaaataaaaaatgaatctttagaagaggctaaagatgatatttcattattagagaaaatagaagctgacaaaattcagcatgctgttcataattttatcaaggaacacaaaattaacagaatatttattcctggaaattattacaacgtagacactgaaccttatacaccaactccaaacaggcaacttgttaccaatgcaatagtaaaaatcatagaagacaatccaaaaattcacttaataggcgtgtgtggtggactacaaggtataatgcatgcagttggaatagaagtcattagagtaaaaaagataattgcatctcaagaagctgtagcagcacattctatttcaatgccagacccacatagaaaagatgtaggacttcatagactccgagttgtacctggaagcagattatcaagcattatttctaaatatactaaaccagatgacaacggatggattgcaatatatttcccagacgcacatggaggagtagtaaataacagtcaagaaaatataaaaaaaatagaatcccttggatatagaatagtaggattttctgacgatggtattatcgaagcaattgaagataaaaatggcaacatcttatttcaagatcatccagaagctttagcaattaacgcaataaagggatctgatcaagatgataatgataatgacaatgatataagaagacgtcaagcaactttgtcagcaattgctattatcaatgattttctttataggaattaaattagattattaaattttgcttatacaggtttaaacattttgtcaggttatataaaacatagattccaaatgttatctcctgtacaataagtatttccttcagcaaaatcataggtcttcttacagtaaactcatactaaaatcaagacacatggcctccacaatatttaataaatttcatattacattatggttttgctattattcgctcaccatacacacccatgatatgttaataaacaagtatttttctaggcacagaattctcgaacaatacttatatgataatcacttctaggaatcatttataaataacttagtcaaaccctataacattattttcttaacatatagatttgattattattcaactacgcctaacagtacattaaacaagtatccctcctaccaccaggatataactacattgcactaaccaatgctaacgaaaacatctcttttcttatactaatttctagtttgcactatccatatagtaagttactaccttacaaaacaatattatttacgtaataatcgtttatcacaattgactattgaatatatatatgatatctgtgctgcaacttgtattaattaatatttttaatgcgtttatcagattactatgtacctacattaaaagaaacatctgctgatatatcagtaatatcacataaatattctatacgtgctggtcttatcaagcaaattgcctccggcatatacacttggcttcccttagggttaaaggtactaaaaaatattgaaaacatagtcagagaagaaatgaataaatcagggtctttagaaatattgatgccactgatacaaccagcaagcttatggaaagaatcaggaagatacgatgactatggatctgaaatgttacgcattacagatagaaatcaacgagaaatgctttttggtccaacccatgaagaagtaatcactgatattctaaggacaacaccagtaagtcataaagatctaccactaattctataccaaatacaatggaaatttcgcgatgaattacggccaagatatggtataatgagatgtagagaattcttaatgaaagatgcatatagttttgataaagatttcagtggtgctatttcatcttataacttaatgttcaaaacttacatcaaaatttttcaaaagttaggcttaactccaatagcagttaaagcagattcaggacccataggaggaaatttaagtcatgaatttcatgtattagcaaattctggagaaagcaccttatactatgaccaagacattattgaattaatgaatagtgagagtattgatgttgaaaaaataaaaaatacttacactgcagcagatgacatgcatgatcctcaggcttgccctatttcatcagataaagtaaaaataagtaaaggaatagagataggtcatatctttcatctaggagataaatattcaaaacctatgaatgctaatttttgcgatagcaataataataagctcctacaaatgggatgttatggcataggagtatcaaggctagtagcagcaataattgaagtatttcatgataataaaggcattatttggccagaaacagtagccccatttaaattttccttagtaaacttatatacatcaaatgataaatgtaagaaagttgcagaaaatctacacatgcagttatatgatgacgttctatatgatgacacagatgatagtcctggtattaagttagcaagaacagatctgctaggtatgccatggcaagttataattggtaaatcaacagtagaacaagaccttattgaagtaaggaatagattaacaaaagataaagttttaatttccacagaacaattcttaaataaattaaaaaaatgatactagggattggtacagacattgtttatgttcctcgtatatcaaatttatggaaaaaatttggtactaaatttcttaaacgggtatttagtgaaaaagaaatagaagatagtaagaaatatacaaattttgatgcacaagtaagacactttgcaaaacgtttcgcagcaaaggaagcttatgtgaaagctgtaggaacaggttttggaaaatccataaaaatgccagatattatagtatctaacaacctacacggcaaaccacaaattaccataaataatagtaatataaaatataaaattgaattatcaatcagtgatgaaaaagactacgctattgcttttgtggttctatatacagagttataacacttgatatagaacataatacaacacaaataacatatggaaaaattataaacaatcagcagatacaagacaaatcaacatgataagtacgctattgttttatagcgatattaaagagtcaagtactgtaaagcataaggtaatttaaacataacaaaaaactaaagtgtacataaactttgaaaatatcatattatttacattcaaatctatatttattaatagtatataatatgaaaagtcgataaacaaaaatttttacaatttaatcagaatgatctattatttcatggcataatatatatccaaaacttattatttagtataattccatttttcaaattacaattattattaaatttttgttgcacgtaaggaatacaatatgtatattgtatatgtcttttcctcggtagctcagtggtagagcacttggctgttaaccaattggtcgctggttcgaatccggcccggggagcgctttaattcaaagttctttgtaaacctttctagaattcttaacgcatttcagtgcttattatgtctatactttaaaaaggcacttattcacgtataaatatattgacttatataaaatatagtattataataacagttgtgcttttagcactatggcaataaaggcatcttaaaatagatgtattggacccgagggcagtgctcggcatctccacttcaggtcatggggatgaaacaggatcgacatgcatagtaaaggggatagtttttgctcggtgagaaaacagccgtttaaatgctcaaaatttataagtgcaaacgataatttcgtttttgctaatgataataatagcagtgctaacttagtagctgcttagttttattattagcgcggtttttttaagggttttccgggcaacagaaaaacccttttttatatgatcagaaacttgtttatgagtaacgtaatagattatcaaaagcttatgcatgctgctatgtgtagtgtagtcaaaaacgctttaactgttgtggcacaatcagaacatttttacaatgtacatattgctatatcctttttaacacattataaaggagtaacactacctgagcatgtaaaaaacaactatccacaagaaattactgtaatattacaacatcaatttagaagcttacaagtatttgataacagtgctagtgtagtattaagttttagaggaaaagaagaaacagttgttattccataccagtctattatcaaatatatagatgtttatcaaggcttcgtactagattttgagcaatatacaaacagtgatatagaagaatttgacgattgcgaccatgatattgatgatagtaatgaagataaaagtcagaaaggtaaccaagataatatcatatttattgatacattcctgaaaaaataaaatttttacgctttattacaacaaattcattaatgtaattcttggtatagtataaatcttcacctagtgtttattcattatgtagttttttgtattttcaaaggttacccacatgtatatctaatactacaaaaattctatttaatctattgtacataatcaattaatcatcaatccagttttaagaatacaaatatacaatacaactctatattctaaatttcaaaaatatgcaacacaataaggaacccttactaggatttagttacgttaatacatgtactcctaaactttatatagatttttccacacaaattttatctctactccatctagcaaattctcaatccacctattttaaggagacaaatatatgatgacacaatctatcaatcttaagtttgatttagtaatgcataaccaagcacataaagaaattactgtaaatgaagcattaataaaaatagatatgctcatgaataactgtattttagaactacaatgcaacaccccaataaaagaaatatcttcgggagatatgtatattattggacctactccagcaattcaagaatggcaaaacaagcaaaataatgtaacatattattacattaaccaatggtactttatacaaccaaatacaggcttaactttatgggtaaaaagtaaaaatcagctttatacatataataatacacaatgggtacctagttataacaactacaaataaaaatacttcattaatttttttagtcgctatgtagaatatgattttactgctgaccttgaagaaaagttggatttaatctctaatgggaagattaattggaaggaagtactacatcaattctggtttctgtttattgataatgttaattcagtaaaaaaactagaatttactgaagtattaaaagttattagttgtgagatggaaaattatattttttcttctgataaatctgaatctagtagagtatgtcctgtatgtaatgatggaacattagagcttaatattagtaagaatggtatttttttaggatgttctaaatatccagagtgtaagtatacaaaaaatgttggaagtggtattgttgatgatacagacaatacacaatatcctaaaatattaggtattgatgctgcaacaggacaagaaatatatcttaaaaaaggtccgtatggtctctatttacagattggtaatgataaaagtggtaaacgtgcagctattccaaaaaatatagatgctaatttattagatttgcaaatggcagaaaaaatattaagtttacctataagcttaggtactcatccggatactggtcaagaaattaagttaggacttggtaagtttggtgcatacatattgtatggtggtaagtatttttcagtaaaaaatgagcataattttttagatattagcattgaaaacgctattaatattattgcgaataattctacaagtggggttataaagtctctgggtatcactgaagataataaagaagtattcttaacactaataatgatattacaaaaaatagatcatgcgttatatgattacttaggggctaagtagttcagtggcatagtaggagaatcataatttctcagtcgcgggttcaaatccctccttagccacttaattcattagcattagagagtccttggtattctattgtggtacctaacattttagagttaatggatgattatacactgagtatcactgtcaacatgatttatgctagcacaatacatgttattttggtatcctattatggtatctgacattttagagttaatggatgattatatactgagtctgccaatattattatgctagctacaatacatgatattctaattattgggccagaggaaagtcagtaggtttatcattgctctacatttgatatactaaccttcatttttttgtcattattgtatttatatataatgtcaagaactaaaagattaaattatcacttagcagtactatattactatttatacataactttatatttctagttataatttttctgatatgagcttaatagcatccgataaagatatttgttcaatatctgtatctttcttcaaagcaacattcaacttatcatattttaaatagaatccatatcttcctttacataagaatacttctttattatcttcagtgatacccagagactttataaccccacttgtagaattattcgcaataatattaatagcgttttcaatgctaatatctaaaaaattatgctcattttttactgaaaaatacttaccaccatacaatatgtatgcaccaaacttaccaagtcctaacttaatttcttgaccagtatccggatgagtacctaagcttataggtaaacttaatattttttctgccatttgcaaatctaataaattagcatctatattttttggaatagctgcacgtttaccacttttatcattaccaatctgtaaatagagaccatacggaccttttttaagatatatttcttgtcctgttgcagcatcaatacctaatattttaggatattgtgtattgtctgtatcatcaacaataccacttccaacattttttgtatacttacactctggatatttagaacatcctaaaaaaataccattcttactaatattaagctctaatgttccatcattacatacaggacatactctactagattcagatttatcagaagaaaaaatataattttccatctcacaactaataacttttaatacttcagtaaattctagtttttttactgaattaacattatcaataaacagaaaccagaattgatgtagtacttccttccaattaatcttcccattagagattaaatccaacttttcttcaaggtcagcagtaaaatcatattctacatagcgactaaaaaagttaacaagaaaaacatttactattctacctctctctgttggaaaaaatcttttttgatttagtataacatactgtctatcttgcaatacagaaataatagaagcataagtagaaggccttcctatccctatttcctccattttcttcactaaacttgcttcattatatctagcaggaggattagtaaaatgttgatgaggtaccacttcatctaaagggcatttatcatttttttgaagtaacggtagcatattatttttactatcatcatcctcaccatgaccatacaccttataaaatccatcaaaaaacaaggaagaacctgtggctcgcaaagttactactttatccagcgaccctaattctactataacctgatcaattacagcagaattcatctgacttgcaacagtccttttccatataagatcataaagcttgagttgctctggagtgagataatttgataaactaccaggagtaattgtaatattcgttggtctaattgcttcatgtgcttcttgagcattttttacctttttcacatacttgcgagcagattccggtaaatattctttaccaaacatagaaacaatgatactcctaatatgctctaatgcttcatctgcaatataaaatccatccgtcctcatataagtaatgagtccaacaatttcccctccaacatcaattccttcatacagtttttgagcaataagcatagtattttttgcagtaaatccaagctttgttgatgcttcttgctgtaaacttgatgtaataaaaggaggataaggattacgctttgtatgctttttctcaacatttataacagaataactacgagatcttacttcttctgacaacttttgtgcatcttcttcattcttaatatcaaacttctctaattttttaccagcataacaacttaaaaatgcagaaaactgcttaccttctgtattgcaacatttagcctcaatatcccaatattcttgtgtaatgaacttttcaatatcactttccctgtcacatattaaccttaaagcaacagattgaactctaccagcagatttactacccggaagttttctccataataaaggagataacgtaaaaccaactaaataatctaatgctctacgtgcttgctgtgcatacacaagatccatattgatacttcttgggcgttttatagattcaagaatagcacttttagttacctcattaaaaaccattctattaattacaacattatcatcaatagcattattttccttcaatacttctataatatgccatgctattgcttcaccctcacgatctggatcagttgcaagataaattccttgtgtttccttattagctacctgaattaacttatttacatatttttctgacttactaataatttcataagtcatagcgaaatctttatccggatcaacagaaccactttttgctggaaaatccctaatatgcccaaatgatgcaacaactttatacttgctacctaaatatttacttatagtttttgctttagatggggattctactataattaaactcattattacaccctaagattaccatttaacaaatccttcttactatgctctatcaatagattagcactattactaacgataattgtgaaaagaattttaaatttattgtagaggtataccagaaaaaagaacaaggtattctacatcacatatatttaaaaaacacttcaataccatactccaccacatatatttattactttttttctatttgacaagagttataataacaacgattactattaattcatttcataaagtaacataagatccatagaaaaaacgtacaacactttacatacatcctctaatatcataaaaaaatacttaaaatgattgaaaacatcatattctacatacgttataattgctcatatacactaaaaaagattaccaatcttaacaaaataatttttttaatacttgaggtatttccagtattatatcatctgcaatcaaaccaataccatacttccttgcacattctgtatgtatccatactccacaacatgcagcatcaaatggactcataccagaagataataatccaccaataattccagataaaacatcaccactacctgctgtagctaaactaaatggagcattatttactacaacattacctataggatcagcaattacagtatccggaccttttaacactatcacagctttcgataaacttgctgcttcccttgccatttctattttaccaccagttaaaaatggaaatatacgcttaaactctccttcatgtggtgtcataacaacattatgttgaattttggaaaaaagaacttcataagaatcagaaaatactgagatagaatcagcatctaaaacacaattttgtttatttaggatatccatagtacgctgtttagtaatatcatttattccacatcctggtcctattacaatagatgtaattctatcatcattaattacatcatcataaagcttgtacataatcgacgttagacaacttgcataaaatgcaacagcattactgtcacaagcaatacttactataccagaacctactctcaaagcagacattgcaacaagttttgaagcacctatagacttattaccaacagaacacactaatgtgtatcccctattatacttatttgatgtatactccaacttaggcattttgtgtttccacaaagcaggagcatttttacgtattacaactttactatcatcaatatcaatgccaatatctacaacatgtacttttccagaataatcacaaccaggaaacaaaacatgccctatttttaataccgaaaaagttacagtaacatcagcacgtattgcacagcccataacctgacctgtatcacaatttataccactaggaatatcaactgcaacaacaactttattattagaatcgttaatatagtgaaatatacacgataaattctcaggtatattgcgcgataaccctattccgaataaggcatctataactaaacaactctgacaattaacaacattatcataagttagtggaacaacccaatcctcatctatatcggtagtacaattatacaacatcaagactactggccagccatgagctttcagtatttttgcagtaacaataccatctttaccattattaccaggtccagaaattattgcaacaggctgttttgggaatagcttaaatataacatcacttatagcctttccagctctacaaataagctcatcaatggccacaccacaactcttttcaaaagaaacaacttgttgaccatttagaataaccataaatgccattttttactaatacacctgaaaggataatatttactaacaaaaatacaagagttatcttaagtgaaattcttcctgtaatgtactaccacacccttccaaattattatgcaataattaatttgatttattcttttttttcttagtttcagcagcaaacttaatacgttcaaattctcttcttttcttgtgccaaccatattggtacattgctattttattttctatcaatgctatagtaccgtcatagtacacaaccatatccatacccttcttctgagcttcaaggaatttttctctatatctatcacgatatgcaggatcattcagtacagaataagtagcactatttgacttattaaaagtatctactacttgtttctttattacatcatgtgtgtaaaaactcattgttattactacctcaccatattaactatattattagttcttatataactatttaatgatgttaattatatcatataactgtaataaaacgatataaaaattattgatatatcacgttttttagaaaaagtgttgttaatttaccacgtaataatatattaataattgaataaaaactcaaattaaattacaatctagattatactattaattcttatcatataaaatggtttcatgcgtaacaaaatattaagcaaaaaatcacaatatattcatgatttgttttcaattacagatacagacgttgtagcaacacatcaacttatcgaggatgatatatccttaatgcaacttagtcttatggaaggccagatattacaattattaataaagatgaacaatataaaatctataattgaaattggaacctttgttggatcatctgctatatgtatggttaaagcattaccaaaagatgggcacatatataccatagaaaaaaacactacaaatgctaaattagcagaagacaacttcaaaaaatacaacttatctaataacataacagtaataaatgacacaggaatatcagcattaaacaaattaactaacatgtcaccatttgacatgatatttatagatgccaataaatcaggatattgtgattacttagattgggcagaattaaatataaaaaaaagtggtttaatagttgccgataatacactattatttggcactgtatactctaatgataatgtaaataaaaaagtatctaaagctacaattaacaaaatgctctcctttaataaaaggctatctgataaaaacaaatatcttacaactttattacctacagaagaaggtatgacaattgcattaaaattgttctaaggattttctcaacttgaatattaatagaaaattaaattatgtgatcaccctctacccaacagtataatattcatatagcaatcttaggcatttatattatcatgtcatcagtaagtattaagtcatattgaaatgaaaaaaagacatactgacaacacacaaaacaataaagtagattttgtaataagaagacatggattgtcagtatgcaagctagccatttttttaatagctccactattatgcatatccagcttatacctttttaatatatacgatagctacataaatataattattaactgcatatttaccagcattagtatattagcaatatcaatacaattaagacaatacttgtatactattgcttctatagaatatcaaaatatgatttttgctaattccttaaatcataatacagaattttgtttaataataaaaaataatggtaaaataatatatgctgatgcaagattctatgaaagatttataaaaaaccaagaaagaaaattagacttatttgatatattaaaattaggtaatatcagtgaacaagaaatcgaagcatttgaaaatgcattaaagaacaagctatcaatcaatacatatttttgtttaaatacaaaaaataaaatttctaactttacactaatattagatccagtattggagaacccagaaatagaaattaactatacaaaaactgtaaatttattttttgctcctcttgcaagaccacaagaatattttgtacttaaagctgtaaaaatcacaaaagaacaagtatatgaaagattaattcaaaaacattgtgtaggagcatatttacttaatcacagaggagtaatattatccgtaaacgacagtttcctaaagatgtttgaattaaattctgtcgaaaatggtactacatttgctaattttttaacaaaaagtgacaacaaagaaaaggtaatagataacaatactgttactctatccacaactacaggaatcacatttaaagcacatatatcacaagctgcattttatgataaaaataatcatagttatatttatgggctcttaactccagtaaattccgatattcttaattatcatttacacccatgtttcacagaagctccaatagctattttacaatgtaatacagatggtaagatcttaaaatcaaataatacactaaaaagattagttaaacacagtaaagaatatatttttgaatatatactaccttcttataataaaaaaattaaaaagtacttccaaaataacattgtaaaaaatatgtcattggaagcacaactctataataactcatatgtaaaaattcattttaataaattcatacatcaaaataacatgtttattatatgttatataactgatagtgaagatcgtaaaaatctagaaatacaattagagcaatctcaaaaaatgcaagctattggacaattagctggaggtatagctcatgatttcaacaatattttaacagcaatcataggtttttgcgacttattattgataagacatactgcaacagatccttctttttcagacataatgcaaataaaacagaatgcaaacagagcaacaaatttgataaagcaattactggctttttcaagaaagcagactttacaacctaaaatccttgacgtaaacaatataattgcagatttactacatatgattaagagattaatcaatgaaagcatagaattaaaaattcaatacgaacaaaatattaatttagtaaaagcagatttatgtcaactagaacaagtaattatcaaccttgtagtaaatgcaagagctgcaatggaaacagggggacagctaagtataaaaacctacaatacgaaaacagatgttttaaaggtactattaaaagacatgttttctccagataaagaacaaatagaagatggagaatacgttgcaatagaagtgtcagatacaggacatggaatggaagataagataatgaaaaaaatctttgacccatttttttcaacaaaagaaacaactgctggcatagggttaggtttatctacagtgtatggaatagttaaacaaacagatggatatatatatgttaaaagtatagtaaattcaggtactacttttattatccttatccctacagtacatttatcaaataataacgatattgaaataccatataataaatattcaaatgaaacaagcaccacagtaccagaagtcaatacttctacaactattttactcattgaagatgaagatcctgttagaatatttacaacaaaagcattgactaaaaaaggattcaaagtcatagatataaattgtggagatcaagcattagacataatcaataaatatcctatagatattgttatcagtgatgtagtgatgccaaaaataagtggtccagaaattgtagaacaaatactaaaagtaaaaccaaatattcaaatcatttttatttctggatatgctgaagaagtattcaataaatacagcaatatagatgtaagtaaaatcaatttcctatctaaacctttcactcttaaacaacttacagaaaaagtactagaaatatcagacaattctttcttgcagaattaaatataacctttattacatacaagcaatatttagctataaaacttgatctaaactcgtttttacaataaaaaccataatatctaaactacaataaaattatatatgaaaaacatctctttactctatactactactcctacttacgaagatgcataccgcataagcaatattctgttagaaaacaagctaatagcatgtgctaatatatttagtaacattacatcagtatatgtctgggaagatgaaatacataacaacactgaatgtgctatcatattaaaaacgacaaatgacttagtccaacatgctacaaataaaatacaagcaatccacccatatgatactcctgcaatcatcacaatagatccaaccaatgcaaatgacaaatttatacaatgggtaaatgactgtactgctttataagcttgctatcacataaaaaagaacaacacacaataaaaatactagagctctaaacagatatatacttgctaccataatatttcaatcatacaactgtctatatagtagagaaatctacttataagtttactattacactagaaaaaacaagaatttaattcaagaattgtagaaaataaagagttcactttcctatacactatagtcattattataatttcatcagacaataagcttatacaggaaataaatccactaataattgtcaaaagaaaattcaaagtattttagcattaaaaattatccaatcaggacgtgtcatctgcaattttctagctgcatcttcagcatgacttaattcattaaataaagcaaaacaagttgctccactaccagtcatacgagcaattacagaattttttaattgctttaatacaaataatatttcttctatctcaggaacaaatttcaacgctacttctaataaatcatttttagcattacaaattaattccatccaatcatcttgctttacaggaagcttatcacatatggaaggagagtaagtagcactctggtaattattaaagacctttgctgtacttaacgtctttccccttggagcaacaagtataatatattttggcaataacaaatcaggtaataacaatatatcttcccctacccctttagcaaaaagggtctttgattccaaacatgctggaacatcacttccaatttttaaggctaaatcctgtaacaatgtgtaatcaatgttccacatattacctagtaaacgcataatagcagcagcatcagctgatccacctgctaaacctgcagatactaaaatattttttataatactcacagaaacattaggacatacagcactgtgtttcaataacaactctattgctttatatacagtattattatatttgctaatcctcagatttgagaaatatactccccgtttcgaaccaccaacatcaacctctaagatatcgtaaacattaacaaagacaaacaatgactctaagtaatgatgttgatcactccgtttaccagtaatatgcaaaaataaattaacttttgctggtgctttaactaaaaactttaacataattatattatcattaacaatatactatacactattaatagtgaagactacatagcttgtaaaatatctttagtgattattaaataaaaaatccttttaataaattttaaatacatacacactgcaatatataatataaatattacacatcataaaatattatatcatcaaattagaaactttttattataatttacttttttattagtgaagcttattatttctttcagaaaaaactatattagacaaagatgtaggacttcgtagactctgagttattcctggaagcagtattaagcattatctataatatatactaaaccagattataatggatggtcggtattttaagattttataatatatagtataccaagtacttacttattactaatatttactttaaaatacagataaaccaataacaaaagtagatcctttctataaaattatatattatattgatagtgttttttacttacatcaaaatataataaactcaaaatattaaaacatatggacattagccaatttatatcagattatccagtaatattagcaccaatgtctggtgtaactgactttccatttcgttaccttgtaaagagccttggggctggattattagtatcagaaatgatagcaagccgtgcaatgattatacaaactaaacaaagtttacaaaaatcacaaattcaaattaacactgcagtacaacttgccggatgtgatccaacaataatggcagacgctgctaaactcaatgaagatatgggagcacaaatcatagatataaattttggatgtcctgtaaaaaaagtagtcaacagttacgctggttcagcattaatgaaagatgaaactacagctgcaaaaattctagaatctgtagtaaaagcagtaaaaattccagtaacactaaaaatgcgcactggatgggacaacaataacttaaattcacctaaattagctaagattgctgaagaaactggaataaaaatgataacaatacatggcagaacaagaacacaaatgtttactgggaaggcagattggaaatttatcagaaatattaaaaaatgtgtaaaaattcctgtcatagttaacggagatataaaaaacttaaatgatataaaaacatcactagaagaatcacaagcagatggaatcatgataggaagaggagcatacggcaagccatggtttatcaatcaagctttacacttcataaaatcaggcacaattttacctgatccttcaccatcagaaaaattaaaaattatcacaaatcattatgatcatatgatagaatactatggaaaagatactggagtaaaaatatcaaaaaaacacataggatggtatagttcttctctagagaattcatccgagtttagatctcaagttaactgttctaatgattacaactttatcaaagacaaaataacagattttttctcacaaaattaatgttgtactgaaaacgcttgtatacaaaataacagtagataattaccacttaatgtatacaaatggcaaccaacaactaataacatattacaaattattttttttaattcaaaccttactagaaatgaaattatagatttttcacaaaaccagtgttttatacaagaaaaacattatatacttccctaaaaaaaagaaaaataataattgctattttacatgtatatttgacaatattacacatttaataaaattttaaatcatgtaaatcactaaaatttatcggaaataaaaaatgcttaataattttaatcaaaaaattattgattcgattctagaattaataaaacaagaagacgactgcttatttaagagctttgttaaacaattctacagtttctcttatgatagcgatattactttagatactaacttttttctatttataacacgtgatctatattaactcatcaagatcaaacaacccagagaaagtaaagttaaaatattcaacatagaagaacaagataatgagacaataagtaacgtaactattatcgaaataataatagattttttcacaaaacatgtattctatacgaaagataatctttgtttaaacaataaacaaatagctaattgttcttctcaatatatatgtcttataacgttttgtaattgacaatgtacttatagcatgatatgaatccaagtttgtcgtttctgaatattattagctatgaaagatctacaaacagataaagaattactcagaactcttgtgagtaagggactcaaacaaggatttgttacatttaacgatatcaacgatgttttttctgactacgtgctgtcatctgacaacatagatgaaactatatcaatgcttcaggattcaggtattaatgttcttgaacaaagtgatgaagacgaggcaaatagcataatagaagaaaacagaatcaaagatgaaatggacgaagatgatgtatcagacaccagtataaaatcttgggattttggacaaacagatgaccctatacgcatgtacctatgtgaaatgagttctgttgaattactatctcgtgaaggagaaattgaaattgccaaaaagatcaaatcagaaaaagtaaatatgctcaggtcactagtagaatccccaatagtattacgtacatttatgtcatggagggatgacttagtaaatgaacaaataatgttaagagatttaatagatttagatgcaaattacaggtatgaatttcctgaaaaattttctgacactgatgatgctagtgttttaggttatgataaagatttaatggatgaacctgatgaagatccagatataccagaagatgaagatgaagaaaacatttcaataaatgcttcaatattagaaatggaaaatgcattgctacccaaagtagtaagcatcttagattcagtaattgcatcagcagaaaaaattttagaactcaaaaaacaatatcaaggtaaaattaaccaagatattgaaaaacaatacaatgacttacacgatagcatatgggaaatgatatatcaaattaaacttagtaattccgcagtcctatcaatcacacaacaaatatatagcttaagtaaatcaatagcagcagaagaggcaaaaattatttcccttgcagaaagctatggtatacaacgcaaagacttcttagatgcatataatactaattctgtattgcaaaaaaaaggcacttctcctcaatgggataacatgttactcaatgaagagagtaatatagtaagtatgtacagtaaaattaagctactgtctggagaaaataaccttaccgaattcaaagcattagtcacaaaaatacaaaagcacgaacgtgcagcaaatcaagcaaagcaagaaatgataaaagcaaatctaaggttagtagtatcgattgcaaaaaaatattcaaatcgaggtttacagtttctagatttagtacaagaagggaatattggcttaatgaaagcagtagataaatttgattacaaacgtggatataaattctcaacttatgcaacgtggtgggtgaggcaagctatcactagagcaatagcagatcaggcacgaactattagaattcctgtacacatgattgaaacagtaaataaaatcaatcgcacactaagacaaatgctacacgaaatgggtagagaaccaacattagaggaattatcagcaagattaaacattaatgtagataagatacgtaaggtaatgaaaatagttaaagaccccgtaagcttagaaagccccataggagatgatgacagtagtacctttggtgattgcatagaagataaacgtgcagtaaagccagaagatgcagcagtacttgcagacttacgagaaataactacaaaagtattatcaacattaacaccaaaagaagagagaatcttacgtatgcggtttggaataggtaaaggtggaaaagaccataccttagaagaagtaggaaaactattcaatgtaacaagagaacgtatacgacaaattgaagcaaaagctttacgtaaactacgtcatccaagtcgtgcaagaaagcttagaggatttttctaaatctatctaataatgattaatttgcaaaataaacacaggttttaactgagaataattacatatataacaaaactttagcgtgtttattaactggataactaatgattttttagtgttatagattaaaaccatcagtaaaatataataaaaatcaaagacacattcatcatgatataaaaactgataaagaactaagtctctaacaaaaactcatataacttttggtaacatatcaaaattaaaaaacacttcaaatcatgaaagcattaataaagtttctctcaaattatcactaactatattaattataccattatatagacattacttctcaagcgtaaaccacatcacataaaaacacatgagttaataaaaaaaactatctgtatcctcagtctaagagcattaagttataaaatacgcaatacctcataactacctctcattcttaataattccataattctcttaatctattatctatttcctgtgcttgattagatagtctttctgcaagatccctttgccccttcaagcgtaaatctaatatctccttctgaatacattgcaagtgatctaaaagcattattttttctatctctttctttgatacatctacactatattctctatcttgtaataccataaaattagatgtagacattcttttgataacaaaatttactatctcatctaaattatttttctttaattctgaaagtaagacctccttagatataacatgattacataaagtaacttttatattaataatattctgctgcaatacatatatattcttatcacttatattaaatttagaaaattgatcaaaaataatcggatcgtcaagcagttctggaaattccataatcacgtataccactctcaattgattatactcttccaaaaaaaattcatcactcacatattttaatctattatctaccttactcaccggattatcagtactcaaaaatttacttttatcttttgaatactgcaaattacggatttgagaataaaaatactttttataatattttacaacgttattatcgctaatctggctaagataatgcttaattcttgcttctaacatgacacactgttcaggcataatagaattcttattaacattaaccctagcaagttcataatcccaaataaactctgatagtaattttgcactatccaacaaagcaattacactatcaacaccatcatttatacaaatatcataaggatcctttcctgtaaaaacatcaacaaattttattatgcatccaggtctaattaaagataatgcaagagatgcggatttaatagaagccattttcccagcaatatcaccatccatccacactataatttccgaagttatttcccacaaatacattacatgctcagaagtcattgatgttcccagtaatccaactacattgctaatacccatttgatgtagcattagaacatccatatatccttctaccactataattttcccctgcttttttgcttcacgcacggcaaaatgcgatgcatatagattttctcttttttgaaaaaaagcacttcccttagaattcaaatatttagggttctgtgtactaataattgatcgaccaccaaaccctataatatttccactagaattacaaataggaaagataaccctattgtagaaataatcttgattttgagaatttaataatcctgtatttttaatatcatctatattaaatcctaaagataataaatatttacccaaaccatatgttggagcataccccatcctaaatttttttactgtatcattagaaattttgcgactccttatatattctattgccacatgattattacgtaattgttcttcaaaccataatgttgcagcatccaatataggagttatacttgtcttattattagtactttgtggcaaatcaataccatatatctctgccaagtaatttattgcacccttaaaatccaaagcattaatatcagaagtaaactgtataacatcaccatttgccccacaaccaaaacagtaatataatcctttttcatcattcacagtaaaagatggcgtcttttcaccatgaaacggacatagtccaataacactattaccccttttagttagcttaactctttgtccaactacatcagataactttattttactcttgataatatcaataacattcatgtcacaactatagacagcctgattcttctaataataaagcatattacttcttataataaatagagccataatttattatacaatcatagaaggttattacaattaaatccagatttagactaaaaacattttttatggttatgtgagattaaaatgtaatatggagtacagcacaccatttttttaaacagagtctgcatacatccactaataatatgaaaaaacattattgataactactgattgttatatcaataaaacatacacaacagcatgagtaagatatgaataaatagtagttagataaaactttgaatagaacaaaaatatactcgtatcattgcaaaaaacatgattaacaatatggaatacagcacaccactttttaaacagagtctatatacattcactacaataatataagaaaaacattactgacaactattgattattacatcaataaaacatataaaacagcatgagtaagatatgaataagtagtagttagataaaactttaaacagaacataaaatacacttatatcattgtaaaaaaacatgattaacaatattttattaattatagttcaactatggatttaccaaaaatactttaaacatactacccatattttcagtcaatctcaaaaaacctgctattaaattttgtttttgaagctccgtagcatttgcaatcagtacttgcagcctttctttaataccaaaattatataaaaaatccctttgcgtcataatcactgaactgagagtagacaaactgttatgtaatacagcaaaattcacatatgcagttatatcactttctcccacattcttaagtaaattattatactgatgattcttgacagactgtatagtacttttatatggacaatctatatatccataatcaataaccactgctgcaccaccactttgtagaatcttattttccatacattttactatagaaacagcttcatcacatatctctattactggatttttcatgtcatttgacatttcaaagatcttatttacttttttataggcaattttaaattcatcgttctctactgtaacatatgtttcacaccaagaatcattggtatacacaaactgtttaacaggcaaagcatcaaaaaactcattagctataattaatacaggataatctggtaaatcctttatatctttacaccagaacactttttcatcttttaaaacatctcgctgcaatttttctaatatagggcttatttcaacaagataaacaaccattgctgcgtaacattgttcgaattttctcaaaactctaacaacatcacttattaatgttcctctaccaggccccaattctactataataaatttagatggagaccccattttttgccaatttaacaatatccataatgcaataacttctccaaacaattgagatatatcaggagcagtaataaaatccccataagtaccaaaaggcatttgtgtcatataatagccgtaatgtacatcataaagggcaattctcataaactgttctactgaaatagcacctccacaatcaaatataattttttttaagtaagaatgcataattaattaatgtattatttacgttaatatgatataaatagtaaaatgggttgtaaatttttaatattatgatgttatctattttcaataaacaattaagcgaacaatcctcaaactatataggagatggtgtttataatttatgtagcatgttaacttccattaaaaataaatacaatccttacaacaaagtaaatcaaccaaacatcaatctttcctttaccattttacataaaaacgatacaaaaggtacaatagatcaggaatatggcaataacataacacataatacattctctaatggtttaggtacaacatctataaatctattagataaaccaacaattaaagaagaaatactatcacaagataataacaattgttatgatgtcacaacccaacaatatgacaccaacaatatcacactgcatagtgaagaaattagttacgaaatggcatacagtttattgctagatttagtaaataatgacattgaattgcttgaagaagttctattaattgcaaaaattttaatcaaagaaggggtcttggttgctccagaatccaaaataaaaaaggatattgctcaaatagttctccacaacataagtaagcaaacaactcaaaattcaggttattcaaggtaaatgagatgccaggaataaagaaatttattgttccatgtgatttcaacggacagagttctccctttgcaatatatattggagaaccaaaaccagaaaaccaccctgtacaacaccaagataactggttagcaaaagaacgtggaggtaacataccagaaaaaattaaagatagtttagcaaagttacatgcattagcacagaaaaatggtatttgtttcgcagatctttgtgtatatgccttaacggtcgcttctcataaaaatactaaaaactcctaaaatatattcatttcatttacaacgtatactcttgctatagaaatttacgctttataatgcaaaacatatttttgaaacaatgtgtaatcttaaaaacagttcaacataaccacacaatatatggtatttgtttcgcagatctttgtgtatatgccttaacggtcgcttctcataaaaatactaaaaactcctcaaatatatttattgcatttaaaacatatactcttgctatagaaatttatgttttatatgaaagacatatttttgaaacaatgcgtaatcttaaaaacaattgaacacaaccacacaatatatgattattatttaaacaatacaattgataaatagcccttatttgtatctctatccattacttagaaagatatgatattaaagcatgcattacaatcatacttattattcctaaattttatatagaatccttttaatacaataccaagacctcatatacagaatcccctaaagtttgaatataacaaacttatacattattttttacagaagtaaaaaaagtccagattacattaatacaattctatataccttaaaatgactttaatatcaatgatcttcaaatgcttcttcccatgttccttctgtagcagcacgagcatattctgtaactctattttcaaaaaaattagtatgctctaccccatttaaaatttcatccaaccataataaagggtttttatttgtatcatatataggttctagatttaattgcaataatcttctatttgcaatatacctaatatattctttaacttctttagaagacaaaccttcaacatctccacaagcaaatgctaagttaataaactcatcttctaatgaaacaattattctgcacgcttcatataattcttgttttaatgaatcatcccatatttcatagttctcttgaataaaagtattaaacaatctgattattgattccgtatgtaatgtttcatctcttacagaccaagctataatctgtcccatacctttcatttttccaaaacgttgaaaatttaataagattgcaaatgaagcaaacaactgcaacccctctgtaaaagcaccaaaaactgctaaagtttttgctacatgtcttttatcatttttcctacattcctcaaacctttgcatgtaatcatatttcttcttcattacctcaaattttaaaaatgcttggtattcaatttcaggcattccaatagtatccagtaaatacgaataagcagctatatgtatagtttccatatttgaaaatgcagaaagcatcatacatacttctgtaggtttaaaaatatttgaataatgtttcatgtaacaattgttcacttcaatatcagcctgagtaaaaaaacgaaaaatctgaactaaaagatttttttctttttccgaaagcactgttttccaatcctgaacatcatctgcaagtggtacctcttcaggtaaccaatgtattctttgctgacataaccaagcatcatatgcccaaggatagttaaatggcttataaattggcctagaatctaataatgacatctctaagtactactgaacaaaaaaacaacatggatcacaagctaaatccaggaaaactataacaactatttaccataaaaatcaactaagatttttttactaaacataataaatacaactatacaaaatattatgtacttataatcttaatatacttatattatattttgactaaaaatattaaaaaaataatttgcatattaaattatttacaattatacagtactgataaaattgtatgtgtaataatgctatgctaacaaaagttcaacaaagagcagcaataaataacataaatttaaagcagtatataagggacatcacattagaaaagattgatgaagctctcatagatatcagcaatgtaataccattatgtatagcactcatgctagatatcacgccagattttacttccttcagaaacgaagtaacatctatgttagaagaatataaggaatggtttattgcaaacggggaagcaaaaatgcccctaattgatgatagaacctcagacactttatggaacagtataaaagaaatacacacattataccacaaacaccaaatgtcaatttctagcaacgatggcattaatattctagatagaatcgcatttaactctgctcacaacacgcaagatattataatagataataaattaaagtataaaattcaatatatcatactgtcatcattcattgatcaatgctttgatactgatactaaccctacaacaatatacaaaacggaaattctactgctaacatctgaaattagaagtaagataacgaacaaattaaaaacaacactatttcagtatgtacaaaaaaaagctttttcctcatatgcagaacatttacgaaatttatataatatacaagcatcatatgtaatagaaaaaaacattgacttattaagaacagccgaacaatttattgggttaaaatcaattcatattttgaaccaaagaacattccgtaaaatcaaccttttgctagacagtggatgcgaaatcaatgttaaatgcgatattccaacatacacagagatatttctagaaataagtgacataactatcttcggcacagtatacggcagcatcttcaataaatatggtagcattactattattgatgcaaaagaagaatgtagcaaaaatatattatctatattcggaactgtaagtatcaatggaaaaataattaagaacaacttacctgatatatttactattccagccaatttctgcagaaatataaaacataaaaccataataactagacaaacagatctctgccaagcagaaaaagtaataacatcatttcatccatgtgatgttatcaatcaaaaagatccaaatggaatacgtgcattaaacatagaactattccaccctaattttcaataccacaccgtcattgcatccataggatggcctatcaataaacaaaacaatacctcaactgaaaatgctgaattgctatttcataatataatacataatgcaaaccacttaaacataatagacaacatcagtaaaaatcagaggctaccaaatactttttttaatgatagcattcctatgtttattcataatatacgtataacaaataaacaattaatcattgaaaatttaagcagtaatatagcactttacttaacatacataacacacagtggtacaaatcttacatctaaatttggtgttaatgaagtaataatacacagtaaagctgtagatttttcaattttaatacttcatgatacagatgtaaccgtatttggtaaattttgcggcttattacatacaaacaaaggtaatattacaattgtaggacaagttagaaaatcgaaaattatatcaaacactggattgattaaaatagaaaataactctcttaatgctacaattccaatagtaatagatagttctataatcgcacaatatggtgcagtagaaattactgggcaatgctccaattcttatatagatagtaataaagtaactagaaaattaccaaacaataccagtactccaccttcatatcttacaagactttcagaaatattttctgcacttacaagaacaatagcaagataattatgacattatcatagtacaaaccataataaaaagattctaataaaaaagtgtgtatcactaaacacagtaaaatttcagtattagcaaatatttacttcatattttactataatctctgtatatgtattcaagataaaactttataacgcagagttataaaaaaattcacttgttattttattatttcttataccaatgcgtagttccatctttattgtcagaaagaactattccacgatttaataaaagctgacgtatatcatctgcccttttaaaatcattattggctctcgctttttttctttcatctatcaattgacttatttcttgattattatcatcaattttaaaccaatcttgccaagaatgctgtaagatacctaaaaaatttgcagtcttaataagagttttcgttaaagatatcttttctatcatatcagctgttttattaatctctgtcaccatttcatgcaacattgaaatagcttttggagtattaatatcatcttttaaacaatcaataacatgactcgataactctacactatcatccaacgataaatcaacatttgtagaactcaaagcagtatacatacgattaagtgattcttgagcactagccaccatttgactattccaatctaaaggttttctataatgagtactcaataacacataccttatcaattcacctgtaatcccactattcaataactgcctaactgttaaaacattacctaaagatttactcattttctcatcattaactgtgagaaacccattatgtacccaatatttagcataacggctatcaggaaaagcacaacaactctgtgctatttcattttcatggtgaggaaattgtaaatctgctccaccaccatgaatatcaaaattttcctttaaataacgataactcatagctgaacattctatgtgccatcctggtcttcctaacccccaaggacttgaccagcaactcattaattgattatctatttcagttgcaggcttccataatacaaaatcccctggatgctttttacctacctctatatctattctactaccataaataagttgtgagatattacgcccagataactgaccataagaagaataagactctatattaaagaacacactaccattatatacatacgcatgaccagaatctaccaacttctgtattaaacttattataacatctatgttgtcagtcgctcttggctcataagtaggttccaaacaattcagcattctcatatcttcatgaaacgcttttatataaattgcagtaacatcatatatgctttggttagtattttgtgcaacattaataatcttatcatcaatatcagtaatgtttcttacatacgttactttaggatatagcaacttcaataacctaaacagcacatcatatataactactgacctagcatttccaatatgtgcaaaatcatagactgtaggaccacaaacataaacccttacattatcaatgctaaaaggtacaaaaggttctttaatgccagttaaagtattatatatgatcatgtaaatttagataaaaaagaaaacatacttacaacaagtttgggacccagaataactaccataagagtaacaataataccaaacaatgatactattactccaagaatcaccatcacaccatctttattaagcatgcccaaagacataattgacacaccaccagctggtatgaaattcgttaaaggtaaaggtatagctattgatatagcacatataagagaaataaaagctataactttctctccaaaactattaaatataaataataaacgaggctttgtaagtttttctgcttttcttaatataggagcagttttttcaataattaaagctaatgttgtacgtttgaaagactttttttctaaccatttaggcatccaaggagcttgcaacccaagcaacatttggaatgcaaacattaataaaggtattgagaatatcgttgtatatcctggaggaacaggtataggtattgcaagaggtaaagaaaataataacatcaatactccaaaaccacgagcatgaagtgcagattttaactcaaacaatgtaattttgtctacatcagcgttacttgtaacttcttccaatagatctgaaactgctttatttttttcgtgcgacatatatacaaactcatttcaaaaactatataacatacttttaagaaaaataacactgtataattaataaaatttactatacatttttactatctacaagtagtaaaatattatttaacaaccaacacatctaattaataataaaaatctatacaacattactttagaaacaatatcttaatatttttactcgccacaaataaaaccacaacaccaccaagaaatcaagtcatagtactattttaagtaattttcataagttaatattcaacataaaattcttagttatcaattgactataattttatataactgatagcatattctagaagtaaaagattgataatatatttaatttattttgatacacatattatgttatctagcactaacctacaattcttgtcctagtatgatatatcaatatcttgtaaataatattccatagtatcctaattcttaaattcaacagtatcttaaaaattaattgcattatactttaaagaagtataatagtattttaacaaaaataatttactattatcattgtcaactatcgcactaaaaaaatgcttaataattttaatcaaaaaattattgattcggttctagaattaataaaacaagaagacgactgcttatttaagagctttgttaaacaattctacagtttctcttatgatagcgatattactttagatactaacttttttctatttatagcacgtgatttatatcaactcatcaagatcaaacgacccagagaaagtaaagttaaaatattcaacatagaagaacaagataatgagacaataagcaacgtaactattattgaaataataaatgataacctaccatttataattgattctattattattgcaataaaaaaacacaatgcatcaatatatcattatacaaatgccgtattaaacattgaacgaaaagaacaacatatacatgcaatctcacctgcacagtcttgtttaaatgatgaaacaagtgaatcaatagtatattttattattagcaatattgacaaagaatcccataaatccttaaaacatgatattgaaaaaaatttacaattagtaggctattgcgttaatgactggaaatcaatgttacatcattttgattcagcattgaacgttatgaaagatctttatgataattctatagaagaagaaatcacatttttagaatggttaaggaaagataacttcatctttttagggtatgaagaatacattgtagaccaacacaaattactaattaatactaaagctaatcttgggttacaaaaaactaatacatctgatgaatctagtaaaaatttatctaactctacagaacatgtatatattatacaatccaacattttatctacagtacatagacatgaatacatgatttgtgtcggattgaggatattcaatcaggataatattttggtcaaagaacattgtttttatggtttctttgcgtcaataatttcatttcaagatgcaaactctattccattgattagaagcaaaataaaagctgtagaaaagagagcaggatttactaaaggtgggcatagtaataaggcactgattgacatcttacaaaggttatctagagatgaattatttcaattttctgaagaagaactattcgaaatttcaatcggtatactgtctttagctaataacccaaaaattaagctttttataataaaaggtcagagtcacagctttgtaaactgcattatttttataccaaaagccttagcaagtactgaacttgcaaataaaatgagctatatattagagcagatgcttacaggtaaagttgtcaataatcaatataacatgttaaacgaatataacttagttagattacaatttatactcaaagcacaagataagttatttagtgatttttcggaattagaaattgaagaaaagttaatcgcagcatctagaagatgggaagataaactacaagatgttatgtgctgcaatttaggatctataaacccatttttacaatatctaacagcatttccaccaagctatcaagaatattttaatccaaaaagcgcttaccatgatataataaaattagagcaagtttgtaaatacaatactagtgaagctgatctttacttgataaaaaatagtgttcactatcagttaaaaatatatatacctcaagaaagtaaccttcaactttcaaaaatactaagtatagttaaaaagatgggaacaaatataatcctacaccacagctatactattacagcaaaaattactgtatacctacatcattttatactgtcaaatactaaacaatcttttgaccataacagtatcaaacaacaattcgaaactacaattaaaaaaatatttgctaaagaaatagaaaatgattacttcaatagcttagtcatattagctaacttacactggaaagaagtcatgctaataagagcactaagtagatatttaaaacaagtatcatttaattatagtcaaatttacactcaaaaagttgccataaaatatccaaaagtcttgtttaattttataaaactatttgaggctagatttaatccagaaatggctaatgatcaagaatctcatgctatagaaaataaaattaatgaactgttactagaagttacagatgtagttcacgatcatattctacggtctatatatgcgctaatcctagcgattctgcgtacaaattattataaagataaagattatttatctataaaattagactcaagtaaagtaccaaacatacctttaccatgcccttttagagaaatatatgtatactctaacctatttgaaggtatacatttacgaggtgggaaagtagcacgtggaggaattagatggtctgacagaactgaagattttcgtacagaaatattaggactaatgaaagcacaaatgacaaaaaattctgtaattgtgccagtaggatctaaaggaggattcatcttaaaacgtgcaccaaaaaatgcagctctactaaaaagtactgctgtagagtgttataaaaacttcttaagaggtatattagacattaccgataacattattgatgacaaatatgtcacacctaatgacattataaaatatgatgaatacgatccatatttagtagttgcagcagataaaggaaccgccacattttctgattatgcaaatgaaatttctgaagaatacaatttttggctaggggatgcctttgcatctggaggatcaataggatttgaccataaaaaaatgggtattacagctaaaggagcttgggtaggagctcaaaggcatttttggcttatggataaagatatatataacgaaccatttacagtgattggtatcggggatatgtctggagatgtattcgggaatggaatgttattatctaataaaatacatctcattggagcatttaatcataatcacatttttattgacccatcacctgatccagaaaaaagttttcttgaacgcaaaaggctatttaacttaactagctcttcctgggaagattacgataaatcatgcatctcaaaaggtggaaaaatctttaaccgcaattctaaaatattggacttaacccctgaaataaaagaattatttaatattagtgaagatcaaatttttcccaatgaactcatcaaacacttattaaaagcagaagttgatatgatatggaatggagggataggaacatatatcaaatcctcacaagaaagcaacgccgtagtagcagacaaaactaacgacgcactaagaattaatggctcagaagtaaaagccgcaatgataatagaaggtggaaacttgggatgtactcaacttggaagagttgaatatgcacacaacggaggaaagatcaacactgattttacagataactctggaggagtaatatgttctgactttgaaatcaatataaaaatatgcctaagactagcaatgcaaaacaagtacatttctttagctgaacgtaataagatattagatgatataatgcatgaagtaccatcaatagttttagaatcacacaataaattagaaacaaaagctttaatgttagaatgtatacaagcaaaaaatagaatagaacaacatcataggctattaaaatatttagaaaaaattcaagtactaaaccgagatatagaatttttaccaagtgatgaagaaatcacaaaaatgagtgctgaaatgaaagggtttacctgccctcaaattgcaatattgatagcatataccagaacatttataaaaaacgaaattatgctttccaatatctttcaccattcaagcaatttatcaagtttatatgaatcccaatatctgctctcctactttcctcagtatataagagataactttgcacagtatataaggcaacatcctttaaaaaaagagatattagcaacttgtatagtgaacgacatagtaaacagaatgggatgcatttttgtcaatcacattatcgaaaatattggaattaccgttgaagatataattaaaatatacgtcataacaactcacatatataacttatatgaaatatggaaaacactagatgaactagatagtaaagttcacattaacgtatatacttccttaattagagaagtacaaaaattcataggacaagttactttctggtttcttagaaattcttctaaaattacaaatatagacacaaaattagatgagttatcatcacaaatatcatcacttgaagaaaacatagaaagtattttatgtaatgaatctctagaaatatacaataatactttatcctctttaagcgagcataatattgaagaatcaattacaaaaaaaatcataaaattaaaatttttgactgtttcccttgatataatacacctaacaaatagttcaaatttacctttattaactgtaggaaaaatatacttccagctaagatcattattaaactttagccgtatacgtgaccttgcagcacacatggaatcaaactcttcatattggcaacgcatcgctattagaaatctacttgatgacttaaatgactaccagtttataatcacagaaagtattttaaaacaggtagaacctacactatcattagcagtaaaattggataaagtacacagcataattaatgacataattcaaagttggtatatcaaaaatcaagaaaagctgaacagatattataattttttaaatgaaataaacacaactcaacttgatttaagtaaattaatgcttataataaaatctcttgatatgtttattaattaaaacaattccaaatgtttagtgttggtatatcggaaattattgtcataatcctagtagtatgcctagtaattgatccgaaaaagcttccctttttagcaaagaacttaggagtttattacaaaaaatttatagatacaaaaggagaagtgcttaactattttaataagttttacatggactgcatagaagaacaaaatgataaagtgactattaaagaaatagtaggaaatgatggaaaagtatataaaagttatgaaataaaaaaaatatcaagtaaaaaagaagacatatgactgcaaaagtattaatagtagatgacttacctgcaaatataaaattgttgcaagctaagctcatgagtgaatattataacgttctaacagcaacaaatgggatggatgcaattaaaattgctgaagaaaaacatccagacataatactattagatgttatgatgccagaaatggatggatatgaaacttgcaagagattaaaatctaatccagaaactacatatattccaatagtcatggttacagctcttgataatacatcagacaatagagttagtggtctcagctatggcgcagatgatttcttaacaaaacctataaatgacacagctttatttgcacgtatcagatcattaacaagattcaagatggttatagacgaattacgattaagaggaaaaacaaatgcagatatgagtttattacacaataatatgatggactatgcaaataaaattgacgatgctagcatcttaattgttgatgaagatatgataagatctgagcatataaataacgttttacaaaagtctttccaacaaactgtagtttcacataatatagatcaagcattaaccctaagtaatacacaaaactatgacttaatcattattgatctagaattttctggagatggattgaggttgtgctcacaactacgtaacaaaatagaaacacgctatactcctattctagtattacttgatgaaaatgaggatccaaaattattaagtaaagcttttgacataggaatccacgactacattacaaaccctatagacagtaacgagcttattgcaagggtaaacgtacaggtaaaaaggaagagatatcaagatgctttaagaatcaatgtagataacagcatggcaatggctataactgatcctctcacagggtgctataacagacgatactttgatatgcattttcataacatagtaaatgaatcactacaaaaagataaaaatctatctttaatgatattagatattgaccattttaaagaagtcaatgatacatttggacatactgttggagatgagctattgcaacagtttaaaaaacgtgtatcagacaatatacgcattacagacctattagcaagatttggtggagaagaatttgttgtaatattaccagatacaacaattactacagcagaacaaatagctacaagaattctttctgtaatagaagaaactccttttaaaacaagtataggtgatataaacaaaaccgtcagtattggtgtagttgaagtacaacagtctgacattaataatataaaacaactagtagacagggctgataagtgcctatatgaagcaaaaaatacaggaagaaacaaagttgtcacatatctatcatagacaaaacgttgtttatagtacttgtactttgtaaatcatatttgatttacaaagtacctacacatatcacatatcacatatcacatatcacatatcacatatcacatatcacatatcacatatcacatatcacatatcacatatcacatatcacatatcacatattaagattataaatacttcaatgtaaaaaaacataagattttaaaatatacaatgcattcataacatcgtataattacaaccagaaaactttatatgacttttacatatttgcttttaattaattagactccccccaactttaagctttacttgtagcttagtaaacatatatattttagaatatctatatttatcaataaactacttcacactctatagcaataaagtatatttaagcagtaatatagtactttacctaacatatataacaacagtagtacaaaccttacatctaaatttggtgttaatgaagtaataatatacagtaaagctgtagattttcaacattaagtctatacatctttatgagtaacgtaagttacattaatatacaatttataacaatttctctaactgcataattgcatctttcatataagatggaacaggaacagtaaagtctatttttttttctcctatgttaatcgataaaaaatatgcatgtaattgtaagttatcatttaatacatgttcacaaaattttccgtatttcttatccccaataatagaacatccaatatgtgaaaggtgtattctaatttgatgttttcttccagtaataggtttcaattcaagtaatccaataccataaggcaatttcttcaatacagaaaacgaagtaacagcttcttgtaaatatgaatcattaactttatctaaagaaagactacgtttgtttttaataatagaatgattaatctgtccaatatcattctttggaatcccttgggttaatgccagatatttcttttctacccttctatttttaaactcatgcataattaatctggatattcttgcattacgcgctaacatcaaaataccactagtatctttgtctaatctatgaacaattttcatagattctccatctctaattttatcaacaatatcactaatactaatcttaactttagtaccaccttgaacagaaatgcctgcaggtttattaataatcaacacgtcatcatcttcatatacaacactattacggatcaaatgaactagaaaatcactatcagctttacaaatttttctaatttgtttcctttcataaatgactctatcatatcttacacaaattacatttccagctttaattcttacatcagacttcacttttgtattatcaagtagcactacacctttacgtaaaaatttctcaactaaagactggggaatttttaatatccttctaataaacttatctatccttatattatgatcatcttcctctacgatataatacttactcatcactatccaaacttttaaaacaacatacaaagaatcactaactttcaaaaaactctaaatctacacgtaaactaaatatatattgctgcacattacctactaatttccattacgtctactattacccatggtgatctaatcttttaaatagcatcaccaactctttaaaacctaacctacactaaagctaaacacagatttaaacaaaacattcttcagtttctattaatatactattctatataaagtaaattctttacaaaaaaatcacatgatatactaactactaaagcaagcatccaattttacaaatagatcataaacaaaatttctatcacaatttaaaactattacataagaaaaacaaaacaagatattgcaatattatttatcattattaaatttcgttcttaaataatcacataaggtaaaattactagctataaataaatcattatcacatacaaccttacctttactttcttcaataaacaattttccaacagcagcttgatatttattaagattagaataaattaacgcatcataagatgctgaacataaataagaaaaacctaaagtcatggatcccatagcacgtattataacagcttgggaattaagttgtttatcaatcataccaacattaagatgcgtaataacaaaatcaattacagccctacttatactttgtttattacctacatgcatcttgatataacgagattgcacattttctgaaaaagcacctactcctttttctacataaaaagtctcttttagtattggagcatcaattacagcagcaacgggctctccttgacgaaaaaaagcaattagtgtagcaaaataaggtaaataatttataaaattagttctactatctattgggttaacaaaccaaaaattttctccaacatcagatgcatctctagtatcatcaaatataatcccatagtcttgtcggtaattatacagtccatcagtaataattttttttgatctcaaataagcagatctagtaaaattacttgcagtggtataagaagattgcatatacctaatttcactaaaatctctgattaaagccctagatgattgtctcgctgactttaacataatattagtaacagaagaaaaaattacagacatccacaacctcttactttaaatacggttttataatatcaattagttactcaacatataatagacttaataattacccacgcacatttttatttctaacatttccttagacatcaacacacaagagataccacctcagcatatgctgcaacatattcttctataaaacacaaatgctaaatatatttatccctttgctcgctcataatagctatcatctggagtataaacaactattctatccccaggtttaataaaagtaggaacactaatacgttgattattttctaacattgctactttataagcagatgaagaaactgtctgtcctttaatgacagcctcggtttcaaccacttgaagagttacataatctggtactttagcagatattatttctccattgtagaatactaaagtaataataatattatcttgcaagtatatacttttatcacccaatatatctttgctaattgtaagctgctcataagttttaaggtgcatgatagtaatcattgacccatcaccatagatatattgataatcagattcatcaacaatagctcgttttatatctccatctgcacgaaacctttcatattgtttagcaccagtttttaaattcttcatttcagcttgtatataggcaccacctttacctggctgagtatgcataacttttacaactaaatacaaagcattattatgttctaatacatgcccaggcctaatatcactacctctttctgccattccttataaacaaaaaattataactctgaaattctattcctaaagcataagtaattcaagaaaaataaacatccatagcaactttaatcacaagtaaatttcatgattcaccacttttataaaggtcttattttatattaacctaccaatgatcaacacaacataaccactatataaataacaacaaacttaggtaagatttaagaataaatataaccttaactaataagtcactattcttatattgatattaacaattttattacttataatgagcaaattagtggtgtattatttatatatcaacataactcatcagtcataaattttaacgtttaaaaagtaaaattgataattacaaccttcaatattcaaatatacaattttcatatttcagttagtatgttacaatctttacaaaaaatatgttagatttcgaactcactgtacagaatctatatactagagaaggcttagtcaaattagataacctattcttatcatacctacagtctaataatcaagatctatatgaaatattaattaaagaacgccagaataatactaaagctgacaatacaccatatattatagaactttcatatatacttgagcatttcataacacaattatttaagattgaggacgaaataataatacaacgtaataaacataaagagttctcagaaatatataaatgtaaaagactatttatacaacgctatgctcttaaaaaatacccagacatcaacagcttaaatatatcagaaacaatacaacaaatcagtcagctatttcaattacctattcaagagaaaaaatttgctcaacaagtattactatggtttgaagatcaagaaaagtattcagaaaacttagacattacagctaaatatgctgcatacatggtacattcgaaatcaaatagtatcttattcaacataccaaataaaatagatttttcaaacctagtccatacaacaacaacaactatcaataatgatacaactgccatgatgtcagaacacatcaaacgcagagatggctttaatcttacccatacacaacctactttatatcaagctttaaataattgtcactactgcattttttgccacaaacaaaataaagacagttgctcaaaaggattactagaaaacaacaatacatttaaaaaatcaatattatcaacagaattgcatggttgtcctttagaagaaaaaatatcagaaatgaatctagtaaaatctcaagggtacactatagcagcattagcaattgctatgattgataatccactatgtgttttaacaggataccacatttgcaacgactgtactaaatcatgcatttaccaaaaacaagatcctgttaatattccaatggttgaaactcaaattgtaaataatgtacttgctttaagttatggatttgaaatatattcattactcacgcggtggaatcctataaactttgaacgacatctaccccaaattagtacaaacaaaaatgtgcttgttataggattaggaccagcaggaattaatctatcacatcaccttttaaatgatggacatactgttgttgcaatagatggattaaaaattgaacctttaccacaacatatttctggagttactcaatttggtgaaaaaacagaattcaaattaattaaaaatgtagaaacagaattatacgaaaacttaagtgaacgcatacctcatggatttggaggagtatctgaatatggaattactgcaagatgggataaaaattatttaaaaatagcaaggttaatactagaacgaagaaaaaattttgcaatgtatggaggaataagatttggtagcacattgacaatagaaaatgcctttgaaatgggatttcatcatattgccattgcaacaggatctggtagtccaaatatgattaacgtacataattctttagtacgaggggtacgtatggcatcagattttttaatgtcattacaactaaccggcgctgcaagaacaaattcaattgcaaacttacaaattagactaccaattattataataggcggaggattaacagcaatagatacagcaacagaagctcttgcatattatccattacaagtagaaaaattcctcacaagatatgaaacattaatacaaatttatggaaaatcatatatagaaaaaaactggacagaagaagaaaaacttattgcaaatgaatttttaaatcatgcaattcaaatcagagaagaaaaaatattagcaaaaacagaaaatagagaagcaaaaattatagagctactacaactatggggaggagttactattgtttatagaaataagttatcagatgcaccaagctacaaattaaacagcgatgaaataaacaacgcactagcagaaggaatatatttcattgaaaatttacaaccatatgaaataaatattgatcaatacaatcatgtaagtaatatcacattgattgatcaatataataacaaaaaaacgctttttacaaaaactattataatagcagcaggaactaaaccaaacttagttagtataaaagaaaaccaacaatttcgggtactaggtcaagattttactcatacctttgacttacaaggtaacaatatagaaatcactacatccccaaaacctacaaaaaaagatagtatattcatatcacctgataaaaaaattagtatttttggagatctacatctaccatatagaggcagcgtagtcaaagcaatggcaagcgctaaaaatgggtatccaatcataacccaagcattaaaacaatgcttaccaataaaagataacctatcactaacaaaattaaatcataaattaatagcacatatagtagacataaaacacattacaaaaactatcaccaaacttaccatatcagcccctcttgcagcagctaacttcaaacctggacagttttacagattacaaaactttgagtgtaatagtttgaacatagaaaatacacaattcgcaatagaaagcttagcattaacaggagtttctgtagataaaaataaaggattaatctcaactatagtacttaacacaggaggatctagtcatctatgtaattaccttaaaaaaaacgaacctattatttttatgggccctactggagctccaacagaaattccccataatcaaaacataattttaataggtggaggagtaggaaatgctgtcctattctcaataggtaaagcattattatcaaataattgtaaagttctatatttcgcaggatataaaaaattagaagatgtatttgaaccatcatccatagaagagtcatcaagtactgtagtatggtgttgcgatgaaaaaaggattgaaccaaaaagaacccaagacaaatcttatcgtggtaatataattgatgccataattcaatataacaatcacctatcacaagacgttgacatacctctatattctatagatagaattcttatcattggttcaagccatatgatggatgcagtatcacatgctatatttaatcaattgcgcactttttttaaaaaagagatcaaagttatagcttctattaattctcccatgcaatgcatgatgaaagaaatatgcgctcaatgcctacaaaaacacattgatcctataacaaagcaagaaaattttgtatatagttgcaataatcaagatcagtatgcaaattatgtagatttcaatttcttaaacgaaagacttaaacaaaatagcttacaagaaaaatgtactaaacactggatagattactgcacacataagttaccctcaaaaacataattcgtacaaatacaagttaagtatcaatacccttaagtttacacaataacttaagtcctacaaattccacaccttactaaacttaatcagatgtactaaaaaactgagatattatttgaacattaaaagtaggcacataatattttccctataaacttacataacattcgatttttaattacattaatcctataaactacaaactttttatttcatattgcaaaaactactaagtaatgaccataagaaatcctatattttcataaacattaaacataaaaatgccagtaacctaatttagcaaattcaatcataaaaattggaacttacatctttagctgaaaataacacataccaacaaaattatgtaaaaattcaaaattgcaacaatatttcccaaattatataaatttatcaaatattaattgcataaaatactgcaaagtttataatccttcaaaaagtctggggttgagtaatgctttataattttattcataatatccataaagagggatatatatttataatgatatcatttcttgcgtcttgcattggatttgctatttcttgtagcttaggaataatttgtttagtcatatcattgctatgtatatattttttccgtgatcctatacgtatggtgccagaaggagatgatctcattactagtccagctgatgggttaatattagatattaaagaagtgaactctcctatagatgattctacacaagtagtatgcattagtatttttctaaatgtgttgaacgttcatgtcaatagaattcctgtttctggaactattaaggctacagagtacataccagggaggttcatatcagcttcactaaataaatcaagcgaattaaacgagagacaaagattaattattgaatccaaaattgacaaccgttcaattattgtagatcaaatcgcaggattaatagcacgacgcatagtatgcaacgtttctgaaggtcaacaagttaattctggagaaagatttggtattattaggtttggtagtcgagttaatttatatctaccattaaatactcacatatcagtgtttaagggacaaacagtaataggtggagaaactattttagcatatttacaagacgctcctaaacaattaacagttaagtctatataataatatgaaagaggagcagagtagcaaattttttcctattactaggttatttcctaatatagtaaccctattaggtttatgtgctggcctgacttctataaaatttacttttattggtaaatgggaatctgctgtaatgttcatcattatagcagcactcatagatggaatggatggtagaattgctagatttctcaattctacaagcggcttcggtgctcagcttgattcttttgcagattttttaaattttggagttgctccagcatttttattgtatttttggtctcttaagcaaataaaagtcataggatggatgctagtaatgatgttcgtcatttgcatgtcaatcagacttgcaagattcaatgtgtccttatatgaagaaaaaaaattagattggcacaaatttttcttcgtaggagtacctgctccattaggagcagtactgtcattaattccaataatgttgaccttttactaccatgataatcattggttagttacaaatttatctgatcaaaataatgtagcaatatactttgccgttattgcatttttattagttagcaacattcctacattttctgcaaaacatatttatataccaaaaaatctatcttatatatttattctactgtttggcatattcattgtatttgcaataacaaaaccatggattacatttccagttgttggaatgatgtatatattatcaattcctataagtagcatggtatacatatacattatgtgcaaaactaaaggtaaaataatctagtacacaattaacaatgacaatccttgaatttgcagatttttttccacacatttctggagtattagagtctattttttctctcacaatattcagaattccactaattattttatgggtaatatgtttaggaacattctgcacactaaaatttaaatttatcaatataagactttttaaacacgctttatatgttctaattaagccatataacaaaaaaaacagtaatactatttctaatatccaagcatttactacagcaatatctggaactataggattaggaacaatttcaggagtaattatagcaatttctacaggaggtccaggagcagtattgtggatgataataataggtattttaggtatgtcagtaaaatttgctgaagtaacattaggattcaaatattacttgttagaaaagaaaaaaaatataggaggaccttttcaatatatcaaatgtggattagctgaattaggattagttaaaacaggaaaaatcatcgcatacatatatgctgtcataatgataatagctatgtcttttggaggaatatcatttcaatcaaatcaagctactgtattattaagcaacaccttccacaaaataaacagcagtactattgttataacactaacactattaagtggattagtaataatgggaggaataacacgtattgcaaatattatgacaaaattatctcccataatggttatattatatatagtcgtatgtacagctgttattattagtcattcagatcaactactttctacgctaagcacaatgctacacggtataatagaaggaaatagtgttactggaggagcaataggatcttttgttgcaggggttagaagatcagttttcgcaaatgaagctggaattggtacttctcctatcatacatgcctcaacaaatgatactgaacctgcaagagtaggatgcattgcaatgcttgaaccatttattgacactgtacttgtatcatttatcacgggaatagttgttatactaactggatcctatagcactataaacagtagtaatcatgtaataataattaacaatatattttccaacatttgtccaatttgtgaatatattatactcccttttatcatattctccttcgcattttcatcaattatcacatactcttattactgtgaaatatcttggaaacatatatttggaaattcatgtcatgttgtattatgtcggacattaataatgtgtatcattctaattagtggattatccaaaaacatagttcctatatctcaattaggagacctgctctttatatttctcacaatacctaatggactgacaattatcttattaagtggtactataaatcaagaacttaagaaatatttatgcaaaaactaattgtattacgaacatctattataacaaccattaaaataacaaattgagtttctcacacaataaagttcatatttcatatcaaaaaaactagcaattctagcttttatatatgttactaaaaaaccatcacaatcaatacacaattttcaaaacacagattaagtataattattaatatattgattatctactatttttatgcaagtcatcatctaaaataaatatatctttgaactatcttgacatatcaactactaataaaatttacatggtatgtatttatacccatattagttaatttgataatttatattgccttattgatttaaaaaaagctatatgctacactaaatttcattaatgtgctcattaagcaatatggtagaagttcgtaatttaatattggctgttattttatctgtattgatcatgatggggtggaggtttatatatgataaatttttcactacacaacatgctatagaagataatacaagttctgacgctatgattccagaaattgatgataattttatacacaagacacgatctgaagtgatagaaagcaataccaacataaggatcaaattatccaatgaaaaaatgaatggatcaatatcattaaaaggagcacagtttgatgatttaatattcaaaaactatcatgtcacaccagataaaaattctgaaggaatagtattattatctccagaggaaacagagaatgtatattttattgagtttgggtggatagatccccaacataaaatcactgtacctactcattcttcaatttggaattcagatcaatcaactttatctccaaataatcctataactttaacgtgggataataaacaaggtgttgtattcaaaataaaaatcaccttagacaatgactacatgttcaaaatagaacaaatggtcacaaataatactgattctataataaatttaattccctatggaagaataaatagatctaaacatactgcagaaaaatcttattggatatcacatgaaggagctgtagggagttttgggaacacactaaaagaatggacatataaagccatcactaaagagaaaaacataaaaatccagcaacaagatataaatgacaatcaaaatcaatggattggtatcggtgacaagtattggttcacagcattaataccaaacgtttcacaaaaaagtaatctaaatttccatgtaaaacatgctaaacataatagtaaagatcgtttccaagtagattttagccatgataactatattgcacaccctaataacacagtaactagcataaattatttatttgctggagctaaagaattaaagctattagatacatataaagataatttaaatatttctttattcgataaagctgtagattttggagttttatattttattactaaacctgtattccttttattagaatatttcaataatgttatagggaactttgggttagcaatactattactaacaatagtaataaaattaataatgtttcccttgtcacataaatcatatgtctcaatgctaaaactaaggcatttacaaccagatattgtaagaataaaagagttatacaaaaacgataacgataaaatgagtaaagaaatatcagctatttttaaaaagaataatgtcaatcctatgtctggatttgtcccagtattaatacaaatacctgtattctttgcgttatacaaagtgttatttgtcacaattgaaatgagacatgcaccattttatttatggataaaagatttatcaagttttgatactgcaaacatattaacaatatttggattattaaagtttaatccacctatctgcattggtatcttaccagttatattaggtattactatgataattcaacaaaagttaaacaatcatagcagtttaaatcaagacaaaactcaagcaaactttatgaaatttttaccttatattttcatatttatcttttcatcatttcctgcaggattaattatctactggatatgtagcaattcgattacaatagtgcaacaattaataataaagcattatgtaactaaaaaattcaatttttacaaaaccgtgcaacaggaggattaattatgtcaaatgatcatatcaatatactaatagtagtatcacaattttattctgatgtagcagatcttttattaaatggtgcagtagatcaattaaaaaaatattctaaacctgtaaaatatgatatagtatacgttccaggatcttttgaaatacccgcggctatagtgtttgcaataatgagtgacagacatcactatgatggatacattgctttaggttgtgttattaaaggacaaacagatcattattattatgtatgtaagggggtaacaacagctctaagtgaaattgcaactcaccatgctgttcctatgggttttggagtaattacagctggaagtttagaaatagcaatggcaagagcagatatcaataaaagaaatgttggtggaaatgctgccaaagcagctttaacgatgattgaattacataacaaatttttaagttaaaattatgaaagataatatatgccacacacatttgtggcattcaaaaaaaacaacaactaggttcctcgctatacaaggaacctattctatgatatttaataactatactataaatgacatcgataacttaattgattatctatatgaaatgaaggaagtattagatttaatacagattgacaatcagctactacttaaaattatgaacacaatgctgttaaccttcaatacaatcaattcaacaattgcaacatttttaaatgagaaatggtcaatagaccgcataaacttaattagcctttctattattaaaaccgcagtttgtgaattaatatgttccgatacagatgcagtaatcattataaacgaatacgttaatatagcgagtcatatattagaaagaacagacgttaattttattaatgcaatattaaatcaagtaaaatttacagcacgtcctgtcctaaataaaggtataaattttcatatcgaacaaactgaatcctctgctatttttaatagtacataaattcatgagaacaactagaaagaacatagtttataacctcatatctacataataatgaataaaaactatttccacaattatcagatcatatttcccctagtattgagtgtaatcacaatacaataaaaacacacacttaagattacaaacatatattattattgaattaccaaaattaactggaaaattgttaatcttcatatatcattaatagtcctactctgttactcactaattaatgtggtaaactaaatatgactgatttgattagtatacgtaatgctaaagaacataatcttcacaacataaatatagatcttccaaaaaataagttaattgtaataactggagttagtggatctggaaaatccagtctcgcatttgatacaatatatgcagaagggcagcgcagatatgtagaaagtctatcatcctatgctcgtcagtttttagattcatgtacaagaccagaagtagaatcaatcacaggtctttctccaactattgcaatcagtcaaaagcttttatcgaaaaattcaagatctactgtatcaactactacaggaatttatgattatttaagaatcatgtattccaagataggaacaccatattccccaataactggattacctataacaaaacaatcactttctcaaatagtagaaactatcttgaaattaccaataggaacaaaaatttcaattttaggtatactaataagagggaaacgaggagaacataataaagaaatatatgaaatcaaaaaacagcactacaaactattaaaaattgatggtattacttatgatattaacaatattccacaactagatagaaataaaaagcatgatattcatgtaatcataaatcagatatcagttctagaaaattctattgacaatataactgaaaacataaaaactgcgttaaaaataggtaatggtataactcacatagaaatacttgatttaccacaagaatacaaaagtgacacgtattacaagaatcaggtactggttttttcagaaaattttgcatgtcctgaaacagaatttagcatagaagaagtagaaccaagattattttcattcaatacatcatatggatcatgcaaaatttgtagtggaataggaaaaaaatatagcgttgacaaaaatctagtcataaaaaatgataatttatcaatttcagaaggagctatacatcctataggcccaattgatataaaaaccattaattacaaaattaattcgcaatttagctatcattactcaaatattattttgtccttagcaaaacattatagttttgatttaacaacaccatggaaaaaattagatgataatataaaagatataattttatttggcagcaaagaagtacaaatacctacacattatcaacacgaaggatataaatattctagaaacaaaccatttgaaggcattataaatatcttaaataacaaagaagacatagttatcgaaaaattagctgaacaatattcatctataaacatatgtaatgaatgccaaggatttcgactaaggcaggaagcactatcagtaaaaattgacaataaacatatcggagaattgacaaggttatccgttatagacgcaatatcatggtgtaaagcactaccgtctagactcaatgatcaacagaagcatatttcacataaaatattagacgaaatcattaaaagactaatatttttaaaaaatgttggattaggttatttaacactcgatcgtgaatcaggaacattatctggaggagaaagtcaaagaataaaactagcatcacaaattggatccggattaacaggaataatttacgtattagatgaaccttcaatcgggttacatcaacgtgacaacacgttattaattaatacattaaaaacattacgcgatataggaaacacagtcatagttgtagaacatgatgaagaaactatcacaaatgcagattatgtagtagatataggtccaggagcaggacaaaatggaggttatgtaattgcaagtggtactccaaaagaaataatggataatcataacagtataactggccaatatctcagtaacaaaaaaataatacctaacttcaaaaagcatagaactttttacaaatggatagaaatcattggagcacatgtaaacaatttacaaaacattgatgttaaaattcctttacatgcctttacttgcattactggagtatctggaagtggaaaatctagcttaataaacaatactctatatcaacatgcaactgatcaactaaataatattaactgtatatacagtaaatgcacatctatatcaggattagaacatatagataaagtaattaaaatagaccagtcccctattggtagaacccctttatcaaattcagcaacatacacaggattatttacccatataaggtcatggtttgctgaattacctttatcaaaagaaagaggatatactataagcaggttttcatttaactctaaaggaggaagatgtgaagcatgtaaaggggatgggcaagtaaaaatagaaatgcattttttacctgatgtatatgtcaagtgtgaacaatgcaaaggatcgcgttataacaaagagactctggaagtaacacatcaaggaaaatctatagctgacatattagatatgacagttgatcaagcatacgaattttttatccatttaccattaatcaaagaaaaattagatgccttacgcagcgtaggcatgggctatattaaaataggacaaacatcgaatacattatcaggaggtgaagcacaaagaataaaattatcaaaagaactatcaaaacgttcaacaggaaaaacattgtatatattagatgaaccaactacaggattacattttgcagacatagataatttattacatgttctacataaattacgtgatttaggtaatacaatagtagtaatagaacataatttacatgtcatcaaaacagcagaatacataatagatataggtcctaacggaggagatgatggaggtcaagtagtagctactgggactcctgaagaaatagttcaaaaccctcatagcataactggacaatacttaaagccttatttaaatgcccaatcataaagctatacataaaaaagcatattataaattaatatacttttacttagcatacgcatacacacacatcatttaccaagaagagtagatgtaagctaatattcagcacagtagagctgaacaacacataaaaactttgtaaacatcaataaactagcttacacctacataccaaacagctacagtaacccaattacatgctgtttacttaagtaaaaaagtatactttacaatatcaaaagtttttaaaactataaccacaaattacacaaatatctctaatatattaacaaatacaatattctacactttgtatattgtttacttaagagaaatataactacacttaatacaccataatctaaatatacaggcccttatcattaccaagtaaccttatacttacaacttcatatatagtacctactaaaatacatataagtcaaaactatgccaaattattatagaattcttgaatataattaaaaataatgcttcacgcttaataatatgccatgcttagaagtctaatatcacataatattattttattaaagcattctaacaaaaattatccacttttcattcattggaacaccttagtaataataggacgttcctaacaagatgtattttacatgtatagaattctaacaagtcatgtaaaaatttataatgtaaatttattcagattattaatagatataaaaatttcttctacagagtacttctttaatctttttctagattaaaaattaatcaaatctcattaacatgtttattattacactacagatttatcaatgtacactattataaaaaacagttatataatatcaattattccaatgccgcatataaaacatacaataaaatagccattttactcttttcataccaattatatattatacttcactttcaattaatgatatgattaatgataaagggtgtgtaatatatgttaataaattgacataaaattaaaactctgtaagtatttaactattcactaaagtacatatatgatacaaatgtttaatattgccgaatatgttcctgttctaatttttttagcagtttcaggctttatttcatttcttttttgcatcttaccaatgcttttagctaaccgtagcccagatttagagaaactttccccatatgaatgtggatttgcccctcttggaaattcaagaaaaatttttgacatccgattttatttagtcgcaatattattcattatattcgaccttgaaatagcattcttatttccatggtctatttgtctttcagacataggcataaatggtttttggtctatgatggtttttttggctatattaacagtaggttttatatatgagtggagcaaaggtgcactagaatgggagtaaactagtatgataaacaagaatgattctgtattaaataatcaattctggcaaagttacaaccatcaaggtttcatggtaactcagttttctgacttaatcaactacatatcaaattgggcaagatcaaattctttatggcctatgacatttggattagcttgttgtgctgtagaaatgatgcacactgcagcaagcagatatgacctagacagatatggtgttatgtttcgtgcaagccccagacaagcagatgttatgatcgttgctggaacactcaccaacaaaatggcacctgcactacgtaaagtatacgaccaaatgacagagccacgttacgtcatttcaatgggaagctgtgcgaatggtggcggatattatcattattcatattcagtagttagaggatgtgaccgcatagtaccagtagatatttatgttccagggtgcccaccaacagcagaagcattattatacggaatattttgtcttcaacaaaaaatcaatagagggaatacttctattacaagaaaatctacacaagactagcatataatacaatactaaaatttattgttaacataatgccattatagctgtcatatgtaagcaccagtcaaattttgatcaaaaataatatttacacaatactactttgacttgcgttattaagtaagaaaaatactatatcgaaataggtattagactcaataatgcacaagctatgaagaaatcctcaatttcacaattatgtaataataaaatttactcttcaacattaagttataccattatccttatcttcaagcctaatatacttactgtatagtgccataaaaaggttctttaaaaaaataaaaaatacctaagttatataaacaagatatactagtattcaacatacataatattaatgttaataccttaattcagaaaaataatgtatagtaaagaaaaaataaaagaggatacagatgtcagatagtaataatgcaatagataatattagtacatatatcaatacatctataaatgtagaatgtgtcataaaagacaatataacgttggaactacattcagatgtacaaaacatctataatcatatttcatttttacgtactgatacaaagtgtaaatttcatattttagttgatatttttgcaatagattatccaacaagattggctagatttgaagtaatctattcattattaagtataatcaacaatataagagtatcttgtaaagtacctttacaagagaatgagagcattccatctattactaacattttcagtgctgcaggatggtttgaaagagaagtatttgatatgtatggaataatatttgccaataatccagatctacgcagaattctaacagattatggattttctggccacccaatgctaaaagattttcctttaactggctataaagaagtacggtatgacatatcaaaaaaagaagtagcttatgaaaacgtaaatttacagcaagatttcagatcgtttgatttcctgtctccatggaaggaattaaagaatgaatgaaacaactattattatataactaaatatcacacattttttatacatgaaacaacaattaaacttaacatcataaattcactaaacaaacttttatgttgttcttctaaattacttatttctacacagaaaaatatacttatattattccatcaagtttattaacattatcatgaataacaaatttcaataaatttttgatattacacaaacacaacatttaactttagaaactttgacaatttattttgttttatacttactaggtttataattttcatcatgcttagctaaaatttcatctgcaataaattcactgcttaccatttttccttttgctactatccaactaccttctgagaataaaggaggtaatattcctttatataatattttcatatgattttccaaatctgttatataaaaagaaataaaatcatcatgtttttctacgctaccttttattatcataccccctattctaatatcacgattattattatatatagcatttgatagaacctcagtcggagtaaaaaaaaatgatatattattttgtaacttatttaagacaacaacaactgacatcccaaatatagcaaatgttacaacagtaaaaagcaatcttttatgttttcttttcatctcttcgatcaatactctctagaattctcttacttttactataactaaaaatgataaaacagcttaacccaaccaataaaccaaaacttacagtatacgcaaaaattacaaacatcatatattacagccttcgttaagtaacattaaagattctagaatatcgaaatccgtcatatcaaattttaatggtgtaattgtaacatatccatcatctaatgccctaatactatcatcagattcacctctactatccttatcaggagcagttctatgtatcgtataagatatactactagcagcatttttcttcttttctattttattatatggcatgtattttccttgacttgtaaatttaataccttttgctgatatcaaaggaaagttaacactcattacagtagatttatcccaagatggagcacctaatagcatatctacaataccctttaagaacttccgtggattttcccaatttatttcaccacttctaccatcatattcctgactgatcgcaattgatggaatactcatcatagctgcttccgccgctgctgctatagtaccagaatatgtcacatcattacctatattaactccactatttataccagataaaactaaatccggtttctcaccaacaatttcttttaatcccagaaacatagtagtagatggagtactgtttacaataaattcagtatcactgactttatacacctctattgcatgtcttaaacctacagatctcccacaaccactacaattacttaatggagcaactacccatatttctgatgcaatacctgctgccatcactatctcttttaaaactttaataccatttgcatgaaatccatcatcattagtcaataatactttcatagcacttttattccctaataattaaacaagtataacataatatagtttttaagcccataacaacaactattattatacttctaacatatataatagatgtattctctattcattaacaataagtactaataatacaagattaacgacctaataatagaacattaataacattatatagctaaaatgctatttcatatgtactatctaaaaatcaatattatttacattaatatatttccaaaaaatcatctccacatatttaaacaataacattttatcctaaaaaattatgatatctaccttttaactgttcataacttaacaaaaacatatgacctttgatacaaaacattatcaatttcgcaactcatatacattttgatattgataataaaatatcttcaactgtttgcacaggatcactactcatggtaattggacgtccaattactaaataatttgcaccagctaacattgcatctttagggctctttacccttttttgatcattacagtcactatcaaatcttatacctggcactataagctttaaatccttttctgtatatcgattacgcacttcctttgcttcaaaagcagagcatactataccatataacccaacttctctagctaacttagacaaaagcataacttgctgaacaggtgattcattaacaccaatttcctttaaatcagaatcatccatactcgttaatacagttacacctaccaactttgttacactaccagatatgctatccatagctctgatcatcatctccctaccaccactaacatgaatagtaagcatagcaacatttaaagatgctatcactgatatagctttacttaccgtattaggaatatcatgtaattttaaatcaagaaatataggaacaccacaatcagctatcgcttgtacaccagataacccatacgctgtaaaaaactctagtcccaactttaccatcgatactcttccataaagcatcttagtcaacagtaatgcatggttgatatcatgagtatccaatgcacaaataatcggattagtaaacataaatattcctaaaaaacattcaaattatactaatattaactatttaacacaactttattaatttgaataaatattatatattacctcatcgtcatattattctgtgtgtaatactaatactttcattactaataaaactaatcattttttatagttcaccagaatatatatattctacatttaaacaaatactgagctttcctaaagtcactatataacaacgttactattaacaacagttcatactatttgaatatatagaataatatattataaatgaaaatgttcagaacattttttaaacagtttaaaaaaattctttgtagttaaattactaacttcctcaaggctttcattccataagttagctaaatattctacaacaaacttcgtcttagctggctcattcctttgcccacgataaggttcaggagataagaatggagaatccgtttccactaacacacgatctttaggtataaaccctgctacttcctgaacaacttttgcacttttaaaagtcactattcccgaaaaagatatatataaccctaattctatcgctttgattgctaattcccttgaagatgcaaaacaatgcataagtcctaaaaatggactttctttcatttctgattccaaaatttccatcattcttttgtccgcatttcttgagtgaattataacaggcaatcctgtttccctagatgcattaatatgagataaaaaattcttctcttgctcccctacttgactacatttataaaaatctaaaccagtttcacctaatccaataactttactatgttgagctaaatctactaactcatctactgaaacagactccccatttgcactattagtaggatgcacacctactgaaaggtaaacttgcttataactttctgcaacttttactaaatcagaaaattcagctatagtagtacatacagtttgcattaattttacattattctcctctgcacgcaaaactacatcttttatttcacttggatcaaaataatttaaatggcaatgtgaatctacaatcatatacttacactaatcatattttttttactaaaattaaaaacaatctaacaaacatgcctgtggtcattaacacaaattcaactataaatacatcaaaacttacatttatcaaaaacataaaactttctaaattataccgtaataacaaaagtcctgtagatcaaggaaactttttatacgcactaacaaatactatactaaacaaacccaccaaaaagattagttactactcataatcttgaaatgaaaaagctatctacaaaaacttatacatcagattatcaaatttttagctcggtttgacagcaacgatatttattactcgttttggaataacatatatatcttttacaacattgccacctattctattcttagctatttccaaagccatagatttaagttgatcatcatcaatatcattagcaactgttaatgctttcacaaatttaccattaacctgcaccacaattgtaacatttctttcaacaagtagctctgaatctgctttaggccatacctgattccataacatacctttaccccctatattttcccataatttttcagctatatgtggaataaaaggttctattactctaattagaatatatattgcttcactcactacataacaatttactgaagttcttatcatttcactaatgatattgcttaattccctaaacttagctacagcacaatttaaacggcaaaaatctaaatcatttgtaatgccacttaaaattttatgcacagatcttctatatttaacatcatctcctattatattttctttgttaaaatttaaattaaacttatcataagaaattattaccctccataatttactaagatacctacttgccccctctataccatcatctagccattctatatcacgctcaggaggagtatctgacaatataaataatcttgctgtatctgctccgtacttatcaataatatattcaagattcaccacattttttttcgacttactcatcttctcagctctaccaacagtaacatgctgaccattttccatcattttttttgcttcttcaggaaataagtaattaccctgctcatccgaataagtagaatgacaaaccataccttgcgttatcaaattagaaaaaggttccttaatattaaaatatccacacttagttaatgctcgacagaagaatctagaatacaacaaatgcaatactgcatgttctaccccacctacataataattgactggtaataacatgttacacacatccttatttattccattgctagttccacaaaatgctgcaaaataccaagaagattcaaaaaaagtgtcaaaagtatcagtctcacgttcagcatccataccacaagatggacattttacatatttccaagtaggatgattgtctaaaggattaccatattttgtaaaatcaacatctttaggtaaagttactggtaaatcttttttatctacaggaaccgtaccacattttttacaatatattatcggtataggacacccccaataacgttgtctagatatcccccaatcatgcattctataatatgttatttctttgcacacccctaaaaatgtaagctttgcaactatagcttttttagcttcatctacagtcataccatctaaaaaatcagagtgtttcataatacctgagccaacataagcttctttatctaagttcacatcaacttcaggaaataccacttgctttactggcaaggaatatttctttgcaaattcaaaatcacgctgatcatgtgctggacaaccaaaaattgcccccgttgcataatccattaagacaaaatttacaatataaactggtaaatttacatttaacaaaggatgttttacaactaatccagaatctattccaaatttttctattgtactagatacatcactgattaaattttttctgtcaaaatcatttatcaattgaattacttttgaatcattaacatattgtaaaatcggatgatcaaaagatactgcaataaatgctgctccaaacaatgtatggggacatgtagtaaaaacttgtaacgttttattaatacctaaaatttcaaaatctattactacaccctgagacttaccaatccatttttcttgcatcaactttactttctctggccactgatctaagatttgtaagtcattcaataactcttctgcaaaatcagtaatctttagaaaccattgaaataattttcttttttctaccacagctccagaacgccatccccttccatctataacttgttcattagcaagcacagtttgatccacaggatcccaatttaccaatgactctttgcgataagctaaaccacactttagaaaatcaagaaaaaatgcttgttcatgtttataataacttggatcacaagtagctaattccttatcccaatcataggataatcctatagatttcaactgacatctcatattatcaatattgctttcagtccaagtatgtggatttatattataagataaagcagcattttctgctggtaatccaaaagcatcccatcctatcggatgaaagacattaataccacaagcacgtttatatctcgcaataacatcacctatagtataattcctcaagtgacccatatgtatgttaccagaaggataaggaaacatctctaaaacgtagcactgagcttgttttgcatcagtataaaaattccattttccttgtatatcttgttctacttttttgaaatcataatgcatggtacaccgttgataaaaattccattaaaaactatttcagcttagttgttgtacagtacattatcagataattcaagcaatacaaaatatacacataccataaagatccagaatcatttctttactttagcatgaatattattaaaatataagttttatatatttataaattaatcaatagataaaaatttgcaaattatatacttcattatcaataaattataaagtgatttaatataatatatctaacatataagttgatttataaagctaaatattaaaatgcgagatgaaggtgtataacaaaaaaactatttctttttattgcaagaatcataaaaatattaactatatgtgtatataattgaataatataaataaaatcatataacaaatatttcatattaataaattataaaacgatataatataatatttttaatatataaattaatttataaagattattcttgtcttactagattacggtacataactatgacaacaataagtaaccaaaatgattacggcactaagtataaaatactcaagttaataaaagatataacatataagaatcactggaaccaagtaaccacagcaaggatactgggcgtagaccaaccaaaaatatctcagattagtaatggtaaaacagcaggattttcattagaacgtttacttatatttttgttacgtctaaaatgtgatgtgaatataacaatcactgtcaataacccagaaattgcattaattaacaaagacaatatggcagagagttccctagaatctattaatcttgtaataatacaaaaagaagattaattagagatttttagattgctctattgcataattttctacatatgctagaataaagctttcattcatatttggtttgttaatggcacgtcttacagttgaagaatgtatgggtcgtactaataataagtttaagctagtgatattagcaagtcagagagcccatgatctaaattctggagcatgtccagtaataaaatacaaaaatggtaaaaatactgttattgcattaaaagaaatagcagcaaaacaattagacgtatcctctttatttaatttgtcagtacaaagatgtcgaaaatatatggagaaatttatcaattcagatgaaccatatattgctcataaaccaaaaaacaatgtcgatatctttcaagcgagtgcagtagctggtaactctgatggattggaaaatagctcaaatagtcgggatgataacccattaggtagggataattttttttctaccccagaaaacagaaacaatacaaattcttagtagaacactactacttgtattactagtatatatacttgttacattttgtttatgaacttttagctttatataggcgcaaaaactggttatctatatgtttaaaaaattagataaaagtacatcagattgctctctacatgatgatacatcactatgggcctccattaccctaacggccactccaatttatactaataaggtcccatatacaaaaatcagaaaaattaataataatcttaatacttcactaaataacaagtatactaatcattatacaccaccaatatacacaaaaccaaatagtacacatgatattagcagtggttcaaatctcaataacaatactaagaagaaaatcgatcaaggaaaataccatatagactccatccttgatctgcacgggtacaccttagatgctgcttataacacattaatgaatttcataattaaaaattataactcagcaaacaaactcttactaatcattacaggatggggaagtactgataagtataatagtaacagtataaaaagtaattttagcaagtggctacaaagcgtacaaatagcaaatttaatattatactatagagaagctaatcgcatacatggaggaaaaggagcattttatgtactattaaagagcaaaaataaaaagatttaatatataaatactagtaacatatacaactaattagattgatttaaagtttaaatttttacaaatatagacattatattaaaacaaaatatactatgtatttatatagtatcttctggtcaatatgaaaatagactttaataccctctttccttcttcaactaaagaatacatatcaggcacaatatacaacaatataaaagttggaatgcgtagaattcatattaatgataacagtgaatccattctaacatatgatactggaggaccacatactgatcaaaaaatcaaaattgacattaatcagggtattgaaaagataaggcttaattggattgtagatagacaagacgtagagtatcataaaagacaagaagtaaacacaaattctgaatacgcatttccactacaaagtaataatatcttaaaagcaaatagtaataaacctataacccagatgtattatgctcgaaacaatattattactccagaaatggaatatgtagcaatacgagaaaacgcactaagacaaaagattctttcttataaaccaactgtcatggcaccagaaattactccagaattcgtacgacaagaaatagcatctgggagagcaatcattccagcaaatgtaaatcatcctgaatcagaaccaatgataataggcaagaatttcttagtaaaaatcaatgctaatattggtaattcagtagttagttcaagcattgaagacgaacttcaaaaaatgatatacgcaattatatacggtgctgatacagttatggatttatctacagggaacaatatacataatattagagaatggattatcagaaacagcccagtaccaataggtacagtacctatatatcaagcattaaacaaagtaaatggagtagtaggagacctagatttcaatatcttcaaaaaaacattaatagaacaagcagaacaaggtgttgactattttaccatacatgcaggagtattaaaaaattacattgactacacagataacaggctaactggcatcgtatcaagaggtggagctattatggcacactggtgtactatacataataaagagaactttctttatacaaattttgaagaaatatgcgatattatgaaacactatgacattactttctctctaggagatggattaaggccaggatccatagcagatgcaaacgatacagcacaatttttagaactcaaaacactaggagaacttacagacattgcatggaagcacgattgccaagttatgatagaaggaccaggccatgttcctatgcatttaataaaagaaaatgtagaaaaacaggttcacttctgtaaggaagctccattctatactttaggaccattaactacagacattgctccaggttacgaccacataacgagtgcaatcggcgcagcaattataggatggtatggcacttctatgttgtgttatgttacaccgaaagaacacttaggattacctaacattcaagacgtaaaagatggagtcattgcatataaaatagcagcacatgcagcagacttagcaaaaggtaatccatctgcttatatacgtgattatgcattaagttatgcaaggttcaatttcaaatggtatgatcaatttaacttatctcttgatccagaaacggcaaaatcactacacgatgaatctcttccttctgagaatgcaaagtctgctcacttctgttcaatgtgtgggccaaaattctgctcaatgaaattaactcatcaaataaaatctattgaagagtaacaaaccgcaactatgttataaagcttgttaagacatattttccagattctgtggataatggggttattaataagaatagtttaaggcagcatttttttgcttatagtaatttatgggttgaatttcagtcgatattacattcgataactttagaaaaacagaaaaattttatcatgcttcataatagataatcaactaagtatgtagtacttgatgtgcatcaacattataattaaattaatttatccattccttataaatattctacattacttactcttataacaaacatctaacctaattaacacaataactatctagagtttcattatctttcaatatatctttattacgttacctatcgattttctatgctcgttatattttacaaattcctgatctacataaaactcatcagcatataaattattattagaagtataatttacaacatctgttaccatatattaaccatgattgtatatgagtattatgtattagtatattttttgctaatttgtgtcctataatttgacccatatttaaaaattttgattaggcatcttttatgtattttatattttgttcatgcaaaaaacatgcactaattgaacatcatcagcaacttagatatttacttctatgactaatatcaaacattatcttttgaatttgaaataacacatcacctttacttaacccagttctaatagtaaaatttgcaaatttttttctgtcattttcagacagctgtatagctataatcgactcaaactctcttatagataaaccacgatataataccctttgcatctgcaataatctattagttgtaacatggataataaaattacaacaactataaaaattagattctatcaatagaggcacatcaagtactacatacttagttgattgtctattatgaaacataataaaatttttctgtttttctaaaattatcgaatgtaatgttgactgaaattcaacccataaattactataagcaaaaaaatgctgtcttaaactattcttattaacaaccccgtgatccacagaatctggaaaatatgtcttaacaagctttataacactgttgtcacaattatataactgacatacaacttgatcagcatcaaatactactgccttaaacaatgttttaaaatagctagcaactaaacttttaccagaacctataccaccagttaatccaaaaatcaccatagttataaataacccctaccaatacaaacacaatctattctcatttctataataaaaaaacttgttaaccaaaaagatcactttataattttaatcatagctctatcattaaaattatatttgtactatttatatatactgacaattaacttatatataaaatgatctcagaagcagtacaagcattaaaaaataaacacttaatattatttcccactgaaactgtttacgcactagctggaagtgcatacagcattgaagcagtacaaaaaatatatcagataaaaggtagatcatacaataaacccttatctttactacttagcaatattgataaaattaaacaattttccactttaacagaacacacttttaaaataatacaaaaactttctcctggacctgtaacttttgtattaccaattcataattataacaaactacctagacaattctttaatgacactattggaatcagaataccagatcaccctatagctctagaaatattaagtaatttcgataatcctgttgtaggaacaagcgttaacatttctggacaacctagtgtcactgcctcacatcaagttcaagaaacaattaagcagcacatttcagtaataatagaagatgacagcttagtaaatggtattgaatcaacagtaatcgacttaacatcatataaaatattaagaacaggagcagtatcagaaaagaaaatccaggatataatacatagtatatagattaacgcataaactttatagtaaaacataaaagttcataaaaaaatattcataccatactgatcaatatatattaaaaaacttatataaataaccttattcaaattaattccttatcaataatcatagcaatttttgctctgatttttaatcaaaccattattattcaacaaaataaaatcagtgtttacaaaaaaaaatatctacgccatactgatcaacataatactagttgtacttaaattaaagatacctaatcaaaatttttaaatatggatcaaattatagggcacacattagcaaaaaatacactaatacataatactcatatacaatcatggttaatatatggtaacagaggtattgggaaagcaacacttgcatatcgttttgctaaatacctaacacaatcaacatatttaaatcattataaccctgatcttttaacaattaatgacaatgaagaaataataggaatagacaaaattagaaatataaaaaactttctctatttaagtacagcaagactcaaatatagaatagtaatagtagatagcattgatagcctaaccattaatgccactaatgcaatgcttaagattctcgaagaaacacctaataactctattatcatattaattagccacaatttgcatgaagttccaacagttgtaagatcaagatgttttacattaggattatcagaccttaatccacaagaaacacaacaagtaattcaaaataactttccccatttagatcataaaaaaataagtcatatctatccaggcaccccaggaatggtaggtcaacacattgatcaagaaattgaactatataaagctcttatttcaatacttaccaatcaatacaataatataactatagaaaacatcataacaactgagatcagcttttataaagtagaacatatactatttactattatgttggatctagcaaaagaaatattaggtataacaactaatttaagtatctacaaacacctaatagacaatataaagaataaaattaacatcaatcaattgctaataaaagtatctcaaatacaacaattaatatcttatgcaaaaaaatttcaactagataaaaaatcagtaatgctaaatttgatcaataccataattaatttactataaactactattaattttcttgaaaatttaatatattagaattggtattaataatactatataaaacataaatggaaaaaattaccacaaacatttaaacacaacatttaaagtgttgttattaccaaatacttactaaattttgtatttatgataatatcataatagttttactaaaaaaaattacaaaaaatgttattatctacttaaaattgcagattaattaataatgctttaagtaataacaaataaatttagttgactatatgaactaacctaatatcctaaatcttgttcagttatgtaaaattaggagttaaaattatgagtaaggatatggtagttagaacactcatgggagagttaggattaacaaaaaaggtatcaagtcaagcttatgacctagtaatgctaagtatacaaaatgcactagaaacttctcatctaattaggttacacaatgttggaacactacatgttatccaatgtgcagaaaaaaaatatcataaccctaaaactgggaagttagaaacactagctcctaagaaaagagtaagatttagatcaagcaaaaaattatcaaatgctattaaccttttagataattaattaggagcgctagcaatggcctttttcattttatgaacggatgtacctataccatgtagtacagattcacaaattaaaaaatgccctatgttaagtgctgatatgtatggtacttttgctataatagcagcactttgataatttaagccgtgtccagcatgacagcctatgtttcgttggtagcagtattctgcagcttttattacttgagatagttcactttgtgtagtattgttacagtattttccagtatgtagctctacgttatcagcagatagtttttttgcttgatcaatttggtctacatcaggttcaataaatagtgtaacatctatgttgtaagtatgtagtttttcaataaatgatattaaataagaaaaagcacgttttacatctagtcccccttctgttgtaagttcttgtcttttttcaggaactaaacagacacattttggtcttacctttattgctattgataacatctcatcagttggggcaatttctaagtttagtggaacttttaaactatttttcaatctaaaaacatcatcatcctttatatgcctacgatcttctcttaaatgcacagtgataaaatctgcaccattgcttactgctatatttgctacttccacaatatctggataatcaacatttcttgcattacgcaacgttgcaacatgatcaatatttactcccaatgcaacatctgacataagcacctctcatatatctactaccaaaatacattatatattatcaataaaattttacacaaatactatattttatttaaagcatatcctctaatctgagaagacgagatattacaaggtcttaatctaacaaacatccacccatatcggcaatttaacaacaacttacaattcgtaaaatacacattcctcatataagtagcaaaaggagtattcaaagcctgacacacatttttaccacgctcaaaaactacaattggcaataatttacaaaaatctttccacctataccaataatgaaaagaaaaaagattatcatctcccattaaccatacaaacttaacattgctaaattccttacatagcctactcacaacattgtaactataacattctttaactctcacaatatttactcttatatcactataaactaactgttgcgataaactcactctatcttcaatactataaccaccatcaaatttcaaaggattacaaggtacaaccaaccaccatactctatctatacctaaccttttaatagcttcttgactaatatataaatggccataatgtggaggattaaaagatccacctaataaacctactgttaatttttttctcataataaattcttcaatataataaacaacccacactattcacatcatcactaatatattaactgctttgaaataatccaataactgtattaaaatgcccacaagaaacacaaatttgcaacactagcattaaccattaatgaacttatcatacaatctataaagtttcttaacttgactagtacaatataagaaataaatgtaatacgttattgatcaattaagatcttcaagtataattatgcattatcaataatattaattttttaaaaatgttttaccctacacgagatctcaagaccatatattccaaagacaacacagtatgtgtagaaaatatactagaaatgatgaatggtacaagtgaagagttacaagcctataaagatgatttattaagtaaacacaaagaaaataccaaaaaaaaactagccgatcaaaaaaaaagccaagaagagatcgcattacatattgcaagtccatctttttctgaagaagcattagcctatgttaattatacaaccaaccaacacattctaaaacacttatcagacagtaaacatatagggaacaaaacaagaatattaacaaaatgtctagaaccactagaacatcaaagaagaaatatgataatggagggaatgtataaagcctcattactaaaggaatttaatcagataatgcaagatgcatctgatgacgactttgaagcattagttaacataatcatatcttgttcacatttaaaaacggatttaacagaacaacaacaaaagaacatagaagcagctatagcaacatataatagggaggaacaaggattgtcattgcaatcaatacgtgaatttataaacgatacaacaggaattgatatatctaatccactaagctctatcaagaaaaaattaggaggaaaaaaagaagatatcaaacagcctttagaatctctagatgaaaagctaattaacgtaataacatctccatacagtgtcacttactttatcctaggtactcttacacttggtctaggaggatttgcaggaccgcttttaccaatacttcttatagtcactgttggaaaaagcttacatggcatgcttacagaggacaaagaaaaagaaggaactattcatagtccctttcaagaaggagtattaaagccatcaagaatatctgagaaaccacaaaactacactgcaattttagaacaacaacataaacaagaagaagacaaacaacaagacacaagcaaacctcacaccagtaggcacttatagtaatataactttgtacataaaacgtatcaactaaaaagcatgaaacgttttgtgttatatttttaagtgataaaatagaaaagccatcatacagtatcaaataatagatgagaaaaacaatacatgcacaaataactaaatggtattagccataataatctagatataaaaacttaaaaaatgcacacaaactttattacattaaataaatacaaagtaaaaacaataaacttctcaatacagtatgtttattcaggcattatttatctcaacattctaatcaatacattaatatcatctctctgtttactgtctgcatcttattaatttttctatctgcttaacagcatgaattactgtagcatgagctctacccccaaaactttttccaatttctggtaaactcttctgagtcaatttctttgataaatacattgctacttgcctaggacgcactaaagttcttaaccttctagtagagtacatgtcagttgtcttaatttaaagaactcagcaactttcctttgaatacattctaattctcaatacagtatgcttattcaggtatcatttatctcaacattctagtcaataaattaatatcatctctcagtttactgtctgtatctattaatttttctatctgcttaacagcatgaattactgtagcatgatctctacccccaaaactttttccaatttctggtaaactcttctgagtcaatttctttgatagatacattgctacttgcctaggacgcgctaaagttcttaaccttctagtagagtacatgtcagttatcttaatattaaagaattcagcaactttcctttgaatacattctaatgtcactgatttgtgatttgcacgcaataaatcagataaaatatcactagctgaatccaaagtaatactacatccaactaatgaagaatgtgcaactactttgttaagcgcaccctctaattctctaatattggatttgatattctttgctaaaaactctaatactttatttggaatattaatacccatcttttcaacttttagctgcaatatacctaaccgtaactcaaaagttgtttcattaatatctgcgactaatccccaacctaatcttgattttatcctttcttcaactccatctaaatcactaggtgatctatcagcagatatcactaactgcttattctgatctattaaagcattaaaagtatgaaagaattcctcctgagtactgtctttaccactaataaactgaacatcatcaaccatcaatatgtctacagaacgaaattgctctttaaacaacattatatccttgcttcttaatgctgtaacatattgatacataaatttttctgctgaaagataagctatttttcttttcgaagaagattttataatataccaagcaatagcatgcatcaaatgagttttcccaagtccaactccaccatacagaaataaaggattactcccagatattggttcattagactctgccactcttctagctgcagcaaaagcaagctcatttggttttcctactacaaaattatcaaaagtaaatctaggatccaaaggagaacttaaatgatcataattatttcttacttccttatcttgctgatctttgatattcactagcaaattagtatcttgattattcacaacacaaatgtctacagaacatacactttgatcttcatcctgccaatattttaaaatttgatccaagtaatgcactaatatccattctttgataaacctagttggagcagacagtaaaaccttaccaccttcattattaatatatactagtacactcaaccaactatcatatatggcattaccataaaacttatgtaatttgacttgaatatctttccaaattacctggttgtcagattgaagcttttcttttacacaatctcctaaaagcccagtaccaccatcattcatatagccaatccaaaactacaatcataacttgaaaaatcataaatcttatagcatcactatatatagagttacgatcctctgcattatacaatagaaaaacaaagtcatctatcaaatttccataaagacactaaatcttccctaatacatagcaatatacaaccaaaaatacactcagcaaaacaaaaatatgtataactaagaaagaaatagaaacatcacgagtaaagtaaataaaaaaactcaatactataattaaaatatcacaactttatataaataatattcattttatttggcttcaatataattaatatcaggagcatctattgctttcatacctatagcatgatatccaccatcaacatataaaatttctcctgtagtacctttacctaaatcacttaataaataaagtgctgctccacccacatcgtctattgtagtattacgcctcaaaggtgcattatatttattccatgtcaatatgtaatggaaatctcctatcccagaagatgctaaagttcttactggacctgcagaaatagcattaaccctaatattctgagaacctaaatcaacagccagatactttacacttgcttctaaagctgctttacatactcccatcacattatagtgaggcatcactttttgagcaccataataagataatgttaatatactacctccattacacatcatcttctctacttttttagcaaggtaagtaagcgagtaacatgaaatatgcatagatgtcaaaaaattattcaatgacgtatcaatatacctacctttcagctcatttttatcagaaaaagcaacagcatgtactaaaaaatccatactttcccattcatcactaagctgtgcaaacatattatctacagtctcttctttagatacatcacattgcaagaccaactttacacctatagattccgctaaaggatctatccttttcttaaaaacgtcggataaataagtcactgctatatctgccccatgcatagctaaagttttagcaatcccccatgctaaagatttatcattagcaattccaatgactaatcctttttttcctttcatcatatcactagcaagcactgatatctccttattttttagacatgctcttacaatactacattaattaatatcttataaataaaacaaaaaaattcaagatgcgggagcgacgagactcgaactcgcgaccttaagcgtgacaggcttatgttctaaccaactaaactacgcccccgataaacataagatctataatgctaaccagcataagaaaggttgtcaataaggttttactttttatcaatatcacaattcttatatgcaaacctgtaggagtttaataacattatctaatatttattgcaattaaataatataaaaaaatttatacctccctactttatatgttcacaacaatgttattccatatcttagctattacagacaaatactatattttcatcaaaacaagtaccattctgtcaaagaatatccgtcagcaattacatttgtaactgtatataaaatctattcttatttacctagcacataactgatcaaaatctatatagttgaaatgacaaacacactttaaaaatcacaactctacaacccaccaattcaacaatatacaattagcattgagaaatagataaacaataaaactttatttaatatagttaatatgattttatattcatcaataactcataactattaattttctaactgctgcttgataatagaatttaccatatcagggtttgctttgccttgcgtttctttcattacctgcccaacaaaatacccaaataatttttctttaccttgtttatattctactactttacttgcattattttttaaaaccctttccacaattacagataaagcattctcatcgcttacctgctttaacccatgttcactgactatcaatgcaggtgatttacctgactcaaacatcatatcaaacacttgctttgctatttttccagaaatagtattattgactatcaaatcaagcagctgtatcaagtcttcagctgtcacagaagattcaccaatagtaattccaagcctatttagtctaccaaaaagctcacctgttatccaagatgctgcaagtttgccatcatgcttctctgcaaccttttcaaaatatatagctacatccttatcagaagataaaatatctgcatcatacttacttagactaaaatcattagtataacgctctcttttctgcataggtagttctggtaaagacgacctgacatgatctatatattgatcatcaatctttaatggaaataagtcaggatctggaaaatatcgataatcatgagcatcttctttagtcctaattactcttgtttgccctgaagtaacatcaaacaacaacgtattttgagtaactatttctccattttccaaagcattaacctgtctatttgcttcatactcgatagcttgcataacataacgaatggaattaagattttttatttcagaccttattccaagctcactacttccaacaggtttgactgaaacatttgcatcacaacgtaaagaacctttttccatatctccatcacatgtttctataaaacgcaatatcatacgtaacttcttcagatattctgcaacctcttcaatagatctgaaatcaggctctgacactatttccattaatgcaacacctgccctattgaaatctatataagttttgtcaaattcatgaatactttttcctgcatcttgctcaagatgaattctagcaatgcgaatttccttcatatcatgatcttctaagacaattttaccttctgttgctataggataatagaactgtgttatttgataaccagaaggtaagtcaggataaaaataattctttctatcaaaagctgaatacttgttaatcttacatgatagagcaattcctgtttttattgcttgataaacacaatactcattaagtacaggcaacatacctggcattgctacatcaaaaagcgctacttgcgtattaggtaaagcatcataagtctttgttgaagcaccagaaaataatttagaattggaaataacttgtgcatggacttctaaccctattactacctcccaatcacacctatttcctttaataatcgtcataaaaatatatcactttaaataaaacatattaaatcaacgctttaatagtgacaacacttcttttgaacaattaatctctctattaattacatagttttcataattatcatctattttagataattcataatgataattcaccataatacccattgaattgtttaatcccttttcagaaatatcagccatccaatttagttgttttataattgccccattacttaagtgaaaatgtgctactggatctaatgctctatcagtatttttagcttttaccaaataataagcacacaactttaaaaataaattcttgatatcttgagataaatcagcatactgtctagcattaacatatgagattatctcatcaatagatacagcaatcttaagctcattcagcaactcaacatgacttggcaaagtattcataatccatttcacaaaacctggtataggagaaagagttgcataaattttaatactttgaaactcttctgataatttattcacaacacgctttattaaaaaattacctaaactgattccagaaagtcccttttgagtatttgaaattgaataaaaaatagctacctttgcatttttaggatccttagctggtatatgagaatctaacaacatttgtatactagtagctatttcatcaacaagagctacttctacaaaaattaaaggttctcttgacatcttataatgaaagaaagaaaagcacctacggtctgaatctaatctatctcgtaaatcatcccatgaagagattgcatgcactgcttcatataaaatcaacttttctaataaagaagcaggagaatcccatgtaatttgatgcaaatccaaaaggccaatatcaaaccagtaagataatatatttcttaaatctttttctagtgaaaaaaacgattgatttttattcaatcgaattacatcagatctcatatctacaataaattttaaaccatcaggtaatgaaataaattgcttaagtatacgtaatctaggagactctagaactgtcatcaattgaaattcacattttcttttcccatcttcatctatttcacgtatataatcccctaccttctcatctatctcaaccctatcagcactaaatttttcttccaataatttaagaaaagctactttaccaacatcagatagattcaaatataaattacctagagatatagtgttatatcttgctttaatctcaccacccttcggattaacacactctttcattttttcataaagatcactaatatcctgatccctagtcaaatctttattaatactactgacccaagaaaatattgcatcagccatttcccccataactttaaaaacactatttattgtcttattccttatcactggtaatgagttatccattgtgaaccacaattaaaataaataccctagataacattattccataccattagtctattttttttagaatataataaaaacttattgactgatttattaataaaatatgataataacaactctaatttacgatgacgatacagctatgtccactattggtgtaaataaggtaattttaataggcaatctaggcaaagacccagatattagggtaatgcaaaacgggaaggagatggcaagcttctccatagctacatcggaaagctgggtagataaggcatcaggcatgcgcacagaaaaaacagaatggcacaatgtagtagtattcaatgaagggttagtaaaaattataaaaaattgcatacgcaaaggaagcaagatatacattgaagggtcattaagaacaagaaaatggacagaccaaaataatgtagatcgctacacaacagaggttatcctacaagggtttaattcagctttgtatatgctagatgctaaaaacaacacaatggataacaatggtatatcagaagattacgctactgaaagtttcaataaagaaaattcgctaaacagtagttgcgatgatataattatcgacgatgagataccattctagtcaacactctaatctactatgtattaaacatttaatcttactagaacaacgctattgcactataccattaatgttcatatcagaactctttataagttaccaacgtataacagctaggattataagaatgatatacacttcaatgaaatgtagcatacacatcaacaatcaagtttgtacttaaaaacaatcgataaccctatagtataattatacaaatacactttcatattcagcaactttcttatctttcttaagacaataaaaaccatataaagaaagtaaagcataaaaatctatacaaagtacaggaggtatactaaatttttccaaccataacaaaactgcaggagttaacatactaaaacatcctactgcaagactaaatgcaactgaatacccagtttgtctaacattcgctggaaataaaagcataattacagcaataagaggtgttgcacatatacctaaagaaaatgctacaagaaaataagttacaatagatttaccaaaaaaccaaataagaggagatatccctataataaaaaacacctgaatacagagagcaacagttgtagttttatatatcctacacagcatagtaaacagacaacacgataaagttactgttaaaatcaataaagcatacaccgacatacttactttgctttgcacatccaagaacacaaagaaagtgtaaaacaaagaattacaaaaaggtacaaaaatacatgctactataaaaggttttttatgattgaatatgacatctaaaataggcatcctagaaattttacgcttacttttataatccaaatactctctactttcttcaacagaagtacgcaacaaaggtaacaataaagacattatcaatccgataataaatggtattctccatccccaagaataaaattgagcttctggaattaaattataacacaacttaaagacaaaacatcctattgcgccaccaaatattgacactagaaaatgactacccattgcatatgcaatattacgacgatcccttacattttctgccatcaaaactacagaccctatttctccagcaaaggataatccttgtaaaatacgaaatactatcagtaaaataggcgataatacacctatagattcaaaaagaggaagaaaggctataccacccactgaaacaataagtaaggttgcagagctaaataaagcaatttttctaccatacttatcaccaacataaccaaataacaatgacccaaaaggtctaacaaaaaaagctattccaaatgtcataaatgacaacaataacgcaaaaccttctgttagatgagaaaaaaacatctgactaaatattctactaaaattcccatacactaaaaaatcataacattctataaatgcacacagaagtactgatagcattggctttaaattggaagttgtcaacatatggatagcaattaaacctactactacaataactacaatcagtagttatgcatgtcaatattattaaaaaaataaaacaattaattaagatttagcatggttacaacacactatttaagataaacactatatgcatactgaaaaaagcttacagctactagaattaacaaacaacttgtctattcaacataatacaaagtttataaaatacctaagagcaggtaacaaataactttgaaaagccagtgttatggcattttattaagtacatacatgttactaataagtactcatcatttgtgaaatttataaaataaagtacaacattatctaactctgattatgcatatgctacttcacattgcttttcattatatcgtttcaaacacaaaagaccaagtaaagagaacaacacataaaaatctaaataaaatataggagacatgctacatccagttaattctattaaccataaacaaactgcaggagtagcaccaccaaggcctgctgcaacactataacacattgaaaaaccagtttgtctaatattaaccggaaataaaaatatcaatatagataagataggagttgcatacatacctaatacaattgctaatataaaataactaactatagagttaagccctaataaatacacaacaggagatacacatacaataaataaaacttgaattaccaatgatacattttctggtttgtatacccgaaaaaaaagaaaagatataaaacctgataccaacattgtaaatattaaaagactataaattggtatacttactttctgctgtatatttaaaaatacaaaaaatacataaaataaagcattagaagctgctattaaactaaatgtaattacagaaatctttttatgccgtaatatgatatctaaaataggaactttagaaacttttttaccagatgtatactctaaatattgtttactttcttcaacagagttacgtaaaataggcaacatcatagacattaccaaaccaataataaatggtattctccacccccaagagtaaaattgagcttccggaataaagttataacacaactgaaaaataaaagacccagttgctcctccaagtattgctattgcaaaatgtaggcttaatactgcaacaacttgatctttcctaacactttctgctattaacacaatagcacctacttcacctccaaaagataacccctgaaaaatgcgcagtaccaccaataaaataggagatattacacctatggaactaacaagaggtaaaaatgcaatacctccaaccgataaaataagcaaggttgcagaaataaacaaagaaatctttctcccatacttatctccaatatacccaaataacaatgagccgaaaggtctaacaagaaaagctattgcaaatgtagcaaacgataatattaatgacaaattctcactattgacttgagaaaaaaacatttgactgaatatatggccaaaatttccatatactaaaaaatcataacactctataaaagcacacaaaaatacagatattattgcttttttactagaaccatgtgacattttagacactaattataacaagaataaaaaggatataacctcatttattctctgtgtcaatcactattaacaatacttgattttaggatatatccttactacatgctcaacaatactattctgattttgatgttaagacaaaacatttttactataaataaatatacatattaacacaaatttagtgtctaatttacaacataagctatagcacaacaatcaaataatctactattcaatatacaaattccctaccaattataaccatttaagctgtacacatacaaatgtacattttttacttatatgactttgcttatggtcagttcagttgttaaaaattatccttcataaagcactttttcagttgtttttaagtttgtattattcatatgtactacacatttgcgcataaattatatctgttgcaaataagacacacataattacagcttaaaaatgtttaaagcttcaagtatttttataatgctatacatagacctaactagaaaataatttttaaaacattaaaagatatgcttttatgaacataaaaatgcatgtttagtagaagaaaaacacacataatacgcatcaaaaattttgataagttttacattatacacaattttataaaatctataattccatcttaggaatagcaaattgacatctatataaaatatccccactcctttacacgtgttataagatcataatcagcgtatttagacatatcacaagatgcagtaaatggcttcataaactccacataatctaatattaactgttttaaagcaacttccaattttttgattaactcagtataattatctatagggactattctcatgtcttctgaacttatcttccaatacattaaccctgagatctccttttttaagctctgctttactgttaacgcctgtattatcatttgcaatgcaactccataattaatatctgattgtgaaggaattgcacctgtcttataatcaatgattatcacactaccatcttttaaacattctaccctatcacacctagatattacttcgatattactattgatctcccaagaaaaaaaacgttctgtaataatttcatcaacataatgagctctttctaaattaatttcaaaaaattgctcagctatcttttggaacttaggccataaaatagtttcaacttgtggaaaatctttatatttatccaacaattctgacgcagcaatttctaccaaatcttcatatctatgttgattattattgcataataaatatttatgtagaacattatgaacaacaatcccaaaatcccgcatagaaaatttttcattaatactcttacatggtaaaatatttaaaatgttacttagataaaagacataaggattctttaccaaagtctctaaagaagttgtagacaaaacattgaatgcaataaccctgttattaatatctggattaggttgaggccttaagtatgccaaactcttagtatcatcacatgaaaatctatcactgatttttgaataaatttcacatttcaaattttctatatcataaagttttgctaaaattcctaatcgcctaatccaaatagattcttcatttattttcccaaaactttttaaagattgtgtaatataaatcttatctgcataaaaaaaactatgtaacaaatatgcaaaataacccttttctctttgaatggaaggcaatcctaattttgtacgtatccacctgtttaacaatgttccacatgaattaacaccataatttatttcattaaacccagcaaagattactattcctctcttaaacaagttaacagtggataatttataattttctaaagaaaagctactatacaaaactgatgttaaaatttcataatatacatccatgccatatacttttattccgttacatgagttttgtaagtcgtcaaaaaattcttgaattttactataaccattagaatcaattacaagattaccttctaataaattctgtatacatacaatatgagctttcactatagaagatataacatcatgttttactttaactaaaggaagtataacacttgttattttttcccaaaaaggtagcaaatctggcaccttctcctttacattattttccatgctaaaaaaatcataaccagaataagatctgataacttttagttcaaaacttgatattaaagcatcataatcttctttaacatatcccaaagtcacaaaaggatgtttaagtaatgataataacgggataggattccatttactcattacaacttctaatgtatgtaatataaaggataatatcagataaccaacattaggtttatctaacaatctttctgcatttacaatagaatttattcttttagtcaacaacaaattatttgtaaacacaatagggctgctgttgacattttcttttataagcatagatacaacttgagcttcctcttcatctgaaatacaagtaattaatttaacacgactataatcactatagttctgaatctcatgttgatgatatttctctaaaaataaattaaaattaaacacactgcttacaaatacagaatgatttggctctcctagaaaaacaatatcatttctattaaccttcaaaatatctaataaactcttcacataatactgataatgacattcttctaatagctgccaatccttttcatcaatacttatatctacatatggaaatattattctactattaggtaatttatacaattcctgaataaagttaacaaaaaaattgtcaaacaccataccagcaaaaatcacagtacaatttaatacttcatcttgtaaatacttaattaagttgcctatatataaacttctatgctctaatatatctaatacttcatctttatttaaaacttctttccactttttagataattcagaaaggaatctagctgccttttgacaatgtgctggtaaatcataatcaaacaaacattctaaattagatattggtatacaatgtacatgcatttcattcaacaatgaagataattcataacctaaagacagtggataattatcaccattttcagaattccacaactttataaactccattaacaacaaaagcttccttattggagtcataattctgacaaaactgtgttcattagctagtagatcttggtctatatctgatagtgacataactttcacttgagcgagaacagtagcatgaaaataaagtttcaattgaccatatagcaacttaacatcttcttgatttggtactataattattacactagaagaatttccagaattatcattaaagatatcaaatgcaaattttgcaactacagctaaaaatgattctggacaataaactgaaaaaatttttcccatgaagcacgctagaccaaaaattattaaagtataatgctaatagtatgcttaacaaattaggttagtttttacaacatttatagttacagcttttctgaaaacactataaaagctcacaaattatctaattaaaaaataagttgatacttatcaatcaaatgattaaattagtacacacatgtaacacaataaactaacaatatgcaatttcctaatactagattaagacgtaaacgttcaaatgagtggttacgtaatttagtaagagaaactagtttatctatacacgacctaatattaccactgtttgtacatgatcgtgatggggtatcagaacctgtaaaacaattacctgacatcaaaagatactctatccctgaattattaaaagtggtagaacatgctgcaaatttaggcataaatgctatatcgttgtttccagtagtagaaacccatttgaaatctgaaaatgcagaagaagcatttaaccctaataatctaatatgcagagcaataaaagaagtcaaaaaacacataccaactattggcataatagccgatgttgcattagatccttatacaatttcaggacatgatggaattgtaatcaacaagcaaattgataatgacgcaaccttagaagttttatataagcaagctttagtcttagcagcagcaggttgtgacattgtagcaccatcagatatgatggatggaagagtcaaaaaaatcagaagtgctttagataactgtaatttccaagatgtatgcatactatcttactctgtaaaatactgttccagtttttataaaccatttcgtgaagctgtaggatctcgctcaatatcccaaacaatagataaaagtacataccaattagatattgcaaacataaatgaagcaatacttgaggcacaaatggatatcgatgaaagtgcagatattattatgataaaaccagggatgccatatctagatgtaattaagtccattagtagcagatgtcagataccagtatttgcataccaagtaagtggagaatatgcaatgattaaagctgcatcacaaaatcacttgctagattatgattctgttatctacgaatctctattaggatttaagcgtgcaggtgcaaaaagtataattacttacgctgcaatagatgcagcaaatatactcataaaaaacaaaatgtaagaaatctacaacatactatttaatacatcaaaacacaaaagttaggtgttcatacttgtaattctctaaatattatagaatggaaatgtatcataacttattatagaattaatgcggtaagtatagaataagtcagataagtatgtacaattcatcaatctttatttcccaattaaattacaatcctgaaaatattgattacaactatgatagcattacaaaatcatatcaagagtcagtatatcaagcagcagatatagccatattttcaagatacgcagtatcaggacacatacaaaaaattccaactttacataaaaattttttcaatcaatgtactaatataataaataaactagcactacaaactaataataaaaacacagcaataatcattggtagcataaaaaagaaaaacaatgtcatatttgaaacaatttatctgataaaaaatggagaaattacagaactaatagaattccctacagattctcaatcttctgatatctcagcaacgtttacaattaataacatcaatgtattgctacttcctatctcaaaaatacctaaattacctattcataataatgacacgttattactgattatggataatacacaatatacaaaaaatacaaattctagagatgatttaatttcaaagttaacattcaataaatacgcagtctatattaaccaaataggaggatacaacaatttagtttttcatggaaaatccttttttactttcaatggtcaatacaatttcttaaacatgtggcaagaagatagtaaagtttgcaaagcagatttagcaaaacaggacaaccataccataacatccaacagcattgaatcagattaccaagcacttatgttagcattaagagactatatatataaaaatgctatgaccagtgtaatcatgggattatctggaggtatagactctgcacttgtagcttcaattgcagcagatgcgcttggccctaataacgtacattcactcatgttaccaacaaaatatacatctcaaatgagtattactgattctaaagaatgcgctatgagattaggtatttcttacaatatattatcgatagaagaaatattccaaacttcactagcagcattacaaaatactttcatagacactcaagaagatattactgaagaaaatttacaagctagaatcagaggtaatatattaatggcattaagcaataagtttaaatttatgttattatcaacaggtaataaatcagaattatttgttggttatgcaacattatatggagatatgtgtggaggatttgctccaataaaagatatatataaaactagagtatacgaactcagtaaatggaggaataaaaatataccagtaaatagtttatgtaaaaaaattgacgttattccttctcagattatagaaaaacatccatctgctgaactacgttacaaccaaaaagatcaagatactctacctgattatgcaatattagattcaatacttacattacttatcgatcaaaaccattctacagaagatataataaaaaaaggatataatattcaagatgttaattatattatacacttaatacaaaaatctcaatttaaaagggagcaagcctctactggaccactcatcaattaatttaggcagaaaacagtgaaggttataaaatcattcaatatcccttatttaatattaaacttatatctgcaatattaaaaacacctaccgttacaaaaaaatcaatattacaaaacctataaccttttgatacattgagtaataagttacacgccaccttccaaaattcgtcaacattttcttattttcatgatactatactcctgtacaattcaatacgacaactataggaagcaagatatctcagttgctatacaagtagttttttctcttaacaactcaatttttagtttatagcacagtcataaatttctaagccaattccactattcattactactacagtgatagctaacctctaatattcacacatcacttagagtagttgagtaaaaaacaattaaatatgctaagttaataaatcctcatttgcttttaatttactcattaaatcttctgccctatctaggactgattgtgggaatcctgctaattttgcaacatgtattccataagatttattagttgatccaggtataatttcatgcaagaacactacttttccattccattcttctactttcatacaaaaacactttatattttctaaatacctatctaactttgacaattcatgataatgggttgcaaaaattgctctactcttgttaacattatgaatttgttcaataaccgaccatgctattgataatccatcatatgttcctgtacccctaccaatttcatcaagtattacaaaagatttatctgtggcttgattgattattgcagcagtttctgtcatttctaccataaacgtagaatgcccagatgcaatattatcagaagcccctactctactaaatactttatcaataactcctatatgagcatgttgagcaggaacaaatgatccaatatgcgctaaaatacctatcaatgcattctgtcttaagaaagtacttttaccagccatattaggtccagtgattaaatgtactctttgcattaatgaaaggtcaatatcattagctacaaatttcccattacgttcaaccacaggatgcctacctttttttatgttaaattcataactatcatcaactataggtttagtataagaatattgtattgccaactcagcaaaagaagttagcatatcaatttcagcaatagcatgtgcagtcatagtgattttatctgcaacttcaataatacatgtacataattgaccaaaaatttttacttccaaattaatcgctgcatccctagcagaaattattttactttccaatgcttttaattcacttgtcgtatatctaatactatttgctagagtttgcctatgaataaagtctttatcactaatcaaatagcttgatgaaacttcaacataataacctaaaatattgttatacaatatttttaaactttgaatattagtaatattacggtacttatcccgtaattcttgaattaaatcattactataactttgaatatatatatattctgacaattgtgcatcatagtcaggattaataaatcccccatctttaacattattaacattattcggtattaacacatcatcaagcgttttacacaaatcatcatatttacccaaccttgaacaaaaatcacctacaacactagaatcaaacttatgcaataaatctaataatacaaaaattttgtccaaagttaacttcagagcatataaatccttaggtgaacatttaccaactttaattcttgttaaaatacgctctatatctgcaataccacgtaatgtttccctaacacccctacacaatgttctatcatttacaaaaaactcaacaatatctaacctacgatttattgcatgagaacatgctaaaggagctgacaaacatcgttttaataatcttccaccacatgctgtaatagtataatctatagaagaaattaaggatccttctaaatctccagattgtgtacaaaataactcaaggttccttaatgctgctgcatctataaacataaaatcaccctttgaataagcttttggaaattccaactgaggtagattccctttttgcgtagctttaacatattccaacaaagaaccacatactgctatctcttcattttttaaatcacctaatccttttaaagtagatattccataaacattacacaaagtattataggatctactcacatcaaaaaaactacccgaatattgtgtcaccgaaaatttgtatttccttaaaatagaatatatagaatccaattccactaacttatcagaaatcaaaacttccttgggattaattctgaacaaatcactatcaagcttatgcaattctgttgtatgataataaaataacccagtagacaattccaaccatgcaatagcataattatggtcaacattaactatacaagataaataattattctcttttgcttcaagtaaagaatcctctaatatagtccctggagtaactattcttacaacatcacgttttactaaagccttatatcctcttttcttagcttcttctgacgtttctaactgctcacaaattgctatcttataacctaattttaccaatctatttaaataagattcactactatgaaagggaacaccacacataggtacattcccctttttagttaatacaatatttaatattctagacgtctctattgcatcatcaaaaaataactcataaaaatcacctaatctataaaataataaatactccttatattgactcttcagcatcatgtactgctgcattataggggttatcttgctatcatgattcactttttacctattgttaacctttatcttacagtatattatacgcagtaacgataaaaagataatgcacaaagtgaataataaatattttaataaaaatcttaataatacataatgacatattaccaattgtattttataattagtaaatatgtagcttgatctaacattaattatggtatccagatgcttactttcttaaagaaaggtgcaaatgttgttataaaagcagctataacacccaccactagtaaattaccccatcaagaaagcgtaggtaaataccttggaggcatgctgaaaagtattattccaggtcaaaaagatcctgctgagaaacactttgacttaagaatgcacaaccgtacccacaaactgggggtagaattaccagcaagaacaagaatagatggtcatgagcaagaagtagctctgaaagtaccatcttataaattaccatatcaaactttacaaaaattcgcagcatggcaagaacaagataaagaaggagaggtagaagaaactaaaaaagataccttaacatcacttattaatcctgtatcagcaactcaagagttcattagaagtaatactgctgataaatattttgaaaaattaaaagcacttgatcagcaattgaaagaaataggaggaaaagttacagtaaattctactccaggtagatataaacaaggattaactatagaattagatgtttccaacaaatcaagaatagcaatagagaaagatgtacgacttgttctagaaggtttaggtataaatgatgaagaattagtcaaaacttttactaaaagactatataaatcatctactgataaaaaaatgagttcagcagatattcacactgagaaaactagttctaatactgatagcaaagacaattctaataatcaagatcatgatatagtatcaccagctaaaagacatggaagtgatacagtatcagcagtacaaaggcaaggagatgatatactatcatcatctcaagaacagagtagtaaaactggatcaccaactaacagtactggtatatcaaacagtgatttttcacttacaaatcctcaaaatatgccttattctaggacccctatgcagagttcacaaatgctacagcagttgcaaaatcaaatattgatgcaacaaaaacctgaaaggatattttcacaggctatgcctactgttatgcaacaagaaatcgatgaaatagcagaagatttatgtcaaggtcttaatgaagggccaacacaaggtaattcaaacaatataggaaagcattttagtaatccaggaaaagtacatgcaagataatacttcttatgacaataacaacgtttttgcaaagattttaagaaaagaacttccatgtaacgtagtatatgaagatgagtttgtattagcatttcatgacatacatcctcaagctcctatacacattctagttattcccaaaggcgagtatatatcatttgatgatttcagtgattcttcagcagacattagacattttttttctattgtaaagaagattacccaccaattccaattagaaaaaactggatatagaattgttacaaatcatggaaaacaaggaggacaaattgttccacatttccatgtgcatattttaggcggaaaacagctaccataataaatcagctaatctactactagtaatgtgtgtacatcatacaagtacttacccatgcaacacttattataaaatcataaaaaattatatagctttaccaacaatgaacatagttcattagttaacatgcataatattacaaatatttaataatatgcatacttgtaataaaccttatatatttacttcaaacccttactgcaatagctaatacacatatgcttcattaaaaactaatcatacaataagtaaatatcttactcaaaatacaacatgctaaatttgttattaaaaataaggtaacaataatcacttaaagtatcttgtgtttaatgtaatattcatttgacaacaaaataccaatagatatactaaccttgtttgaaatatgtgaggtacagtatgtacagccttatgggtgtttttacggcattaattacaccatttaaggatgatttttctatagatgaaaacgcgttttgtcatctaattgaagaacaaatcagtaataatattcatggtttagttccatgcggcactactgcagaatgtcctactttaagctttgaagagtactgcaaagtaatcgaattatgtgttaaaatcacaaataaacgtgtccccataatagctggatcaagctcaaattctacacaagaagctattaaacgcacgttatatgttcagtctctaaatgtagatgcagctttagtagttgtaccatattacaatagaccaagtgatgaaggaatatatcaacattttaaagcagtacatgatgcaactaaccttcccattattgcatataatatacctaatagatctgctattgatgcaagcgatgcattacttgcacgaattttatctttgcctagaataatagggcttaaagattcaactggagatgtaagtaggcctcttaatttaaaattattactaaataaagaagtagttttattctcaggtgatgattctacatgcttagggttctatgctcaaagtggtagtggtggtaggactggatgcatttctgttgtttcaaatgtgatacctaaaatacatgctgatatgcacaatgcattccttgctaataatatgaaagaagctatgaatgcaaatttatcagtatttaaattagcaaaagcattgttttgtcagtcaagccctgcaccaacaaaatatgctatgagcttaattaaaaatatctcaccagcagtaaggttgccattagtggaattaactcaagaaaacaaattaaaagttgaaaaaacgctaaaagaattaaagttaatttaagacatattcaataacctggggttatggtaataagcgttggtagtttgtatattatgctttttattatctaatatgcttgacatggtatattgatgtggaatataatgcagtataagtttcacagctcccttcaaattttcctattgtaatatatctttcttacgctgtgactttccacataatcagcattcacatcaacggagcaaaaatgacaacatcaatgctagaaattcaagaatcactacataatcttacatcttcatgggaagagtttaaaaatctaaatgaaaaaaaattatcagatataagtaaaaaaagttctacatacccatccatattagaaaaattagaaaaaacagaaagcatgctagaaatacaaaatgaaagattggatcaattagaaatatcatcacagcgccctgttacccatgataacaaacactataatgaagattataattataaaacgttcacacaatacctatgtaaaggcactaatcttcaaggtcaaagtagtgttgtgcagcccttagatgaatcgtactttataccacataacatatcatcttatatagaaacaaatctaactaagaactcagtaatgcgtcaattatgttctatagaaaaaatatctggagatagtttagactgctttatcagaaacaacaatgaaaagtctgttaactggagaacaagcaataacgtagaagatacagaatcaccaaaaattgataaaattactatcaatttacatgaattatatactcaaccaaaaataacaaagaaattactagaagattctactatagatgtagccagctggttaattaatcacttagttgatgatttcagcagagcagaaaataccgcttttatatctggtgatggaaacaacaagccatatggtatcttaacatatgcttcagacatagaaaataacaccataacatctacaacactaaatagtgatataattatcaaactttattattcacttgatgaatatttctccagaaaggcagcattcataatgcacagaagtgtactacaagaaattagatctttaaagttagcatctggccaatatatatggcatccaggactaacatcaggaagtcctgacacattaatggggttaccagtatatcaaacatccgatatgcctcaattagacaataaaacattaccaaccatagcacttgcagactttaaaaatgcatataagatagtagaaaaccgttcaattaaaacattaagagatccttttacaagcaaaccctttgtcaagttttatacaacaaaacgagtaggaggagcagtcattaataaaaatgctataaaatttttaacaataaaataaaacacagtagcattttttctacatcaaaacattatctaaatattttttactaagaaatacaaagaccacataatacctttcaatccttatatttaacaaataaagatgcaaaacattatgtgtaaaaactagaaaaacaacacaaacctacatgcccatagcatttgaatattcatttcaaatatatgttgctaataacaatcaatgctaccacattacagtattagagttattatataaaatagtgcatactaaaatctacacaacaatttaccataataattctaatactacacttatcactatatcacctatctagaaaaccaataatacaaaattactacataataccctatccatatttatgcattattagtaataatcaatacatgttcagcatttatacatttaacaaatttttcactacaatttattaaatataactcaacataacactataaaatttattagcaaagccaatacatacaaaaaattctttcattaacaaccaaagaaattttatacattcaaattttatatagatagattttttgcaatataaccgtggctattactcatcacacatatctcaacttaacacatgcaacaaaacatcatcctgttccttactatgcatactcgcatatccagctgcagtagcagcagaagcaggacgggaaacacatattggtcgcttagattgtacattgattttcattaaaaccttttcaatataactattaacaaatagccacgctcccatattcatcggctcttcctgacaccaaactacctctgcattctgataatttcttagttcatttgctagttgttcttctggaaaaggataatactgttctaaacgtattactgctatattatctatttttcgtttatctcgagcctcaattatatcaaaatatactttaccactacatattacaactctacgaactttctcattactacataatgggtatacttcaccaattacaggaataaaagatccagcaaaatctgataactttgatactgccattttatgacgtaacaaagactttggagtaaacacaacaagaggtttacgaaaatctctacatatttgtctacgtaatacatgaaaataacttgcaggagttgtacagtttacaacttgcatgttatcttctgcacataattgtaaatacctttctattcttgctgaactatgttcaggaccttgaccttcatatccatgaggaagtaataacactaatccactacagcgtaaccacttagtttctgcagaagaaataaactgatcaacaataatctgtgcaccattagcaaaatctccaaattgcccttcccatataactaaagctgcaggagaattagtactatatccatactcaaatcccataactgcatattctgataatgggctattaagaacttcaaaacttgcttgtggcactcctaaattattcaaaggaatataagtacttcctgtaacctgatccactaacactgcatgtctatgtgagaatgtacctctaccacaatcttgaccagataacctgaccttaatattttccgataacaaagatgcaaaagctaacgcttcaccagttgcccaatcaatattttcaccagaagataccatatcaaaacgtgtagataacacccttaatatttttttattcccattaaactctttaggaacatccactaatgcatgggctaattttaataacttttgttcatctacccttgtgtcagataaataatctgcaaaattaccaggtacaggtcttctaaaattagtccaatttccctttaaccaatcagcttgatcaggaacatagttctctgactgtacaaactcttcattaagcatactattaaatttagctttcaagattttgaattcttcctctgtaatgacactttcactaattagctgctccttataaagagtcataggagttttatgcttcataatacagtcatacatgacaggttgagtaaacaaaggctcatcaccttcattatgcccataacgacgatagcatactatatcgattaccacatctttgttaaatttctccctatactctatagctagcttaacagctgctactacatcttcaggagaatcaccatttacatgaaaaactggagcatctattaattttgcgacatctgaacaatagaaagaagatctagaatctttaggatctgtcgtaaaacctatttgattattaactactatatgtaccacaccacgaatctcatatcctgccaaattactcaaagttaatgtttctgcaacaacaccttgaccaataacagaagcatctccatgtactaatactccaaatatagaagatttatcacattcttctaatacatcttgttttgctctaattttccccataacaactggattgacagattctagatgagaaggattaggacataaagacaaatgtacagttttattggaagataattgacgatcagaagaataacctaaatgatatttaacatcaccagaaacatctatatcctttggatatgcagttcctcctttaaattcatatatcatagccctatatggctttttcatgacctttgttaacacgctcaatcttccacgatgcgccataccaattactatctcacggaaattgtacacagctgacaagtcaatcatttgttcaatagcaacaatcaaagaatctcctccttcgacagaaaatctcttgtatccgggatatctagtatgaagtaactgttcaaaacattctacttccattaaatgttgcaatattttcttcttttcatcatttgatattccgttacaaaaactttcaatcttgttttgtaaccatagcctttcttcatgatttctaatatgcataaactcatagccaagtttattacaataaatagatttcaaagtattaattatgtcatctaaagtagggttatgtaatcctaatacagaattaaatgtggtggaaggcttgatatcacctaaatcaatatattcatgataatctaaatcactggctacatgcaactttaaaggatctaaatcagcagcagtatgtccataagacctaaaaaagtttaataattctacaattttagcattacagttatcaataagatccagactctttgattggtcgatagcattaatattttccgataaatgcaagttattagaaaaaaaattacgccactctagagaaacagaattactatccttttgataacacctataaatatcttctataacatctacattatcagtaaataaacaagttacacccttcatgtttttaccattttaaaatttcaataaacttaaagccattgcaagaattcatattgttcaaatcaaaatattcctgataattcaaattattaactgtacataatattataaaacacaattttgtagtactatatccacaaaactcaaaaaaactcaataatacttttattcattacagacaccagtttccgcatcattaattttaacctctttactagtattacaaatgctttttcgaaattgcaaactactgaatactaccttataacaacatgaactatcatcttccttatcaggattaaatattaaacccataacaacaaaatatacctctcatttcctaaaactatgagatttttactaaaatttactcacagcatctattatcgctcaaatacagaataatttaaagctaaaaaaattattataatacctattgcactaacgatatttagcatatgtaacaccataaaaaataatttaaacactggtacaaatatatatctaataaattagctacatgacattctaaataatcaaaatatgcttgatggatcaatttacttctgctagtattttcagtaagagttatttttcagtagcaggccagtccctgtatccttacaagaatgtatttcctattatttacgagttctgttttgcattacaaattcgctgattttctaatctgcaaatcacaaagataaaaacatctaacaatattatttaaataatttcactatgaattttacaacagcaccctcctactattttaagtacaacatatgaaaaacattgatcctgaattaaaacaacatctatcatctgaagttctgactattgcatactgcttacaaattattctacaaaacaaaaaaataatagggttgaccaactttgatcaaaacttaatcatagataacataacctatgaaacaacacctgggttaaacatagacatattaaaatatgacgctatttctggtaatagcacaaaaatagaaacaaccataaatagcaacataataaaagaagaagaaatattatctggattatatgattttgctacagtaaaaatattttttgtaaattatacaaacctaactcaaggcagtgcaatattatttcatggaaacattgataagataattctaaacaatgataaatttacagcagaagttaagagcacatttaacattctatctagaaacataggcgaccttttttcatcttcatgtcgagcacaattctgtgataataagtgcaaattaaacaaagaagcatttactaatatacacagtattactagagtagtaagtaatcaagaatttgaatgtatcaacttaataaacattgataactactatacatacggatcaattgtgttcattacaggaaaaaacagtaatttaacactagaaatccaagtccacaataaatcatatataaaactttacacccctactccatataaaatctcaattaatgatagattctccatagttgctggttgtgataaaagttttactacatgtagtaacagatttaacaatggtaaaaatttccggggagaaccacatattcctgaaatacatttttaagtaataaaaaatacaaaagtaagacacaataaagacagtaatacaattactaacaacaagaatttttagaacaaaattgtatgatcacactacaatcaaacatttaatatattatcattaagaatacaaaacaaaatttaaattattgcaattcttactttctcacaatgcaataaatcaatatgtaacactaattgagcattcacctatacattgcacataataattaaagaatactatgcactcataaacacttccttcagccaattttgaactttctataggagttatatttatgtcattaattatactatcaaccattgtcaatagtgttaaagaatccatagaaaaattccttttaacagaattcagcaatattattcatcaagatacacaacataatttttcagattcaaacatccaaactaaacatataccaaaaatcaatcatttaaaaattcaaacatcctcatatggaaaaatgattcctatattatatggaagtatgcgtattgcaggtaacataatatggatggacaaaatcacaatcaatacaaacaaagatataactgttataaacaatccaaataaaaagtctacaagccacagttctatacaatatacatatcatacaagtctagctatagcaatatgcacaggacatgttaaaaaaatctcaaaaatatgggtcaattcacaaccattagatctagacacaataacttatagattttaccaaggtacagaagaccaagaacctgatccactaatattaaaattaatgggggatgcaccagcatatcgtggcttatcatatatagtaatagaagattttttactaacagatccaaaaattcctaactttacattcgaagtaacagcacaatctactaatgcctcttatcaagaacatataacacaaaaaatcaaaagtatacacattataccaggctctggagaatttgcatacgatacaaaaatacaaatgaaaatttttcaacaaaaaattggtaaacagtacattccttatggaaaagcacaacaaattaataaccacagtagacatcaaaaagcagatgctttaatttccctagatcaattacaagaaagccttccaaatgtacagtggatatctgttattgtaaattggtacacagatagtttaaatattaaagattgccatatttacccagccgttgagttcaaatttgatgctactacaacacctgacaactggcatgtagcagaaataaatagagaaacagcaagacaaatttctcaggacaacattataggcggaactatcaatgataaatctttaattagatatattaaagaactcaaaacacgaggttacaaagtattactatatcctacgatcatagcagatattcaagaagattcatggataggcaatcttactggagacgcagaatatataagcacattttttaatgagcaatataacccatttattaagcattattgcaatttaactaaagacataatagatgctattgtcattggttcaagttttatcggtttaactagaataaaaaaccatcacaaccattatccagcagtagatgaattaataaagctagcaagttatgtaaaaaatcaaatgggtaacaacattattgtaacatatgcagcagactggagagaatatcactcttacaacggatattacaatatggacacactatggtcatcaaaagacattgatgtagtaggtataaacgcatattttccattaacagatattcctcaacctatagatggattttcagaacaagacataatcaatggatggtgttcaggagaaggatatgattacttctatactaatccagaaacaaaacaaggtaaaattccatatactgaaaataaccaccaatattcctggaaaaatatcaagaaatggtggagtcaatatcacattaacccagacaataccatcaccacttggattccaaaattaaaaaaaatatggtttactcaatatggatttcaaagtatagacaactgtacaagtcaacctagcgtatccatagattatcaatacaataaaaacccaatcttttcaaaaggacatgtaaactttcatgcacaaaaagttgcaataaacggtaccatcaaaacatgggacaattctgatatagtagaacaaatgtttctttggggatgggatataaggccttatcctcacttcccagaactaaaaaatacctggaaagatgcaaaaaattggcaaaccggctattggatacaagaaaaattatccttgctcgaaatctctcacataatctacgatttactaaaaagcacagggctacaaaataatcaaatcaaaatacaaaacctacacaatgaaatagatggatatataattactgaaagacaatctacaaaatccatattaaatgtactaaaagatttatataactttgaaatagtcgagcaagataatacgttagctgttattcaagaaaatcaactgcttctatacaatatttcatcaaatgatattctatccaacgataaaaacaatagtcagaagattatcaaaacaaaagcatcaaatttagttcatagcattaacttcatgtatattaacaaaaatcatgaatataatgtaagttcacaacgtgtcagaatccctaactttgaaaattcaacaatacaagacattcaagtaccaatcgttttaagcgataatcaagcaaagactatagctgaaaatattctaaataaaaaatcaaacaataagtataatttttatcttacattaccaataaaatatgtttggcttaatactaatgatataattcaagtagaatataatcatgttttatacaaaataaaaattataaatatctacttagaaaatatctcaatcagtatagaaggagtactttacaatagttcattaactactcaacatcttattcctgacaatgattttaacagttactctgataaatatattatagaaaacccaatacatatatttgactttccatgtattcacaacatagacaatattctatacttcgcaatcaccagaattaaatcagtctgggaaggaagtattctatactcatatgaagatcaagatgaacactacaaaaacgttttatctatagatacagaagcaactactggaattactattagtaatttaggcattggtccaattgctataccggatcaaacaaataaaataacaattttcctcaagacaggacaattacattcaatcaaatccttatttatggataacagtagcaacctagcattaatcggagatgaaataattcaatttcaaaacgttaaacaaatcagagaaaatatataccaactaagttatatgcttaggggaagatttggtacagaaagacacattgatcaacatcacaaaaaagaactttttacattactagataatcttccttatctcaaaattaaccaatcactaataaataaatccttaatatataaggtagtacttaaaaaatctacatcttatgctaaacaatcaacatacacatattacgcaaataacttaaaaccattacctgttacacatgtcaaaggcaatcgtgatatatacaacaatctaacagtcaactgggtaagaagagcacgcattaatggagaatggaacgataatactgacacacctatagacgaaaaattcgaaagctatgatattgagatttcagacaaccagaatatagtaaaacgtacaattacagtcaaagacagtacaacatttgtatattctgcccaacaacagaaaatagattttaattcaatacaagagaaaataaatgtgacaatataccaaaactcttacatcataggaagagggatagcttataaaactactttgtaaatgcaaaaaaattatagtgtagataacttatacaaatcccatgtttttaaacaaaataaaaagtgctaaaaatacctatagtttatcaaacttaccaacattcattctgaaattctattataatatcatgattctaagtactacgtaaaaactttatacatttcaagtaataagtcttaatctacaacaatatctactcatatacaaaactaatattttcaataacttaaagcattaataagggaaattatttattagattaaactcttaatataacctgtcttacaattataactgcgatcaatataaacattgaatacataactgtactcactttttataaatattcaataacttaacataataaaaattattgtattagttcattaatcattatattcttaacagagtaaaagcagttatttagagttaatgcaaggtttatacatcaagtcatatggctgtcaaatgaacgtttatgactctctaatcatggaaaatataataaaaccccttggattcactgtagtgaatgagccatctgaagcaaatattgtaatattaaatacgtgtcatattagagagaaagcttctgaaaagctatattcagagctaggtaaaatgagaaaaatacaagaaacaaaagacttaactatagtagttgctggatgtgtagcacaagctgaaggagaacaaatatttgcaagagctccatttgttgatatagtggtaggtcctcaaagtatacatacacttcccgaacttattataaaagctcgtaggatgaaaaaacaagttatcaatattgatttccctataatttcaaaatttgatgcaataccagtagaagagtacacaaaaaatcaagaagtttctgcttttatttcagtacaagaaggatgtaataagttttgtacattctgtgtagtaccttatacacgtggtgaagaatactcaagaactgtagaagcaatatttaacgaagcacttgttttatcagattctggagtaaaggaaataaccctaattggacagaatgtaaatgcataccacggaacatataaaggatgtgaatgggatttaggaaaattaattcagtatcttgcaaaaataccaaatatagaacgtataagatataccacatcacatccacgtgacatgcaccaatctctatatgaagcacatagatctgagacaaaactaatgccattcgttcacctaccaatacaatcaggctcagatagaatactaaaaaaaatgaatagaaaacatactgctgaagaatatatagatattatcaataatttaagaaaacaacgccctgacattgctttttcatctgatttcatagttggatttccaggagaaacagaagaagattttgaacatacaatgaaattagtacaagaagtaaacttttcacaggcatatagttttaaatatagtccaagaccagggacacctagtgcagaatacccaaatcaaataccagaagaaataaaatctcagcgtatttttagattacaagaattattaagagaacagcagcttgcttttaatagaaacatgattggtcaaacttgttctgtattgtttaataataagaaaggaaaatttgataatcaaataataggtaaaactgaatatatgcaatcctgctacattaacacagataataccaatcaattttataatagtatattacctattaaaataatagacgcttatcaaaatagcgtaaccggcatagttgttaattgataaaatgcaatgcttttgccgtaaatataattttaacatctaaaactttctaagatacattcataatagtttctcaacaatgcttatctattaagtaataacatcaacaaataaatgagatattcacattaccaatatagatttcatacacaaaaaaattccttaagatacaccaaaattctataatatcaggtacatgcaataacattcttaagatatacataaactacaacagtatattataaaaaacagatatccatctaacatttagatttactaattgtgaagacaacatggattttgcatactaaccgtactaaaaattccccattacataatacaaaatttaccaagaatcaaagtagcttctcataccctataacacatactattaaattttgaaatacattatactaaccaacatatcataaagtttccacattggacaacaaacgagaaaggacaaatctggaaagttatatatgcatttatatcaacatatacaaatagtttatcaatattctaacgcattatatactaaaaaaatacctcagaaaaattacaaaaccctaatcctacagaaagtatcacgacaaaaaaataacaaaataaacgatagaaaaataagcactggcataaaaaagcttatgtgtattatatcatatttattttgatattccaaagcaagtccaattaaaaacataatgacaccacctacaatacacatcagtccattaataagtgaacaaacagtccctactttatctttatccacaacatctgtaccaatagaaaaattcaacatatgtccaccagatgcacatccaaatataaatactaaaaaacacaaaaagtataaattactactatataataacaaactaagactaatacattgtaacaaacaaaaacccataagcacatgttttctattttccaatatattagaaattgcatttactaaaggacaacctatagcaaaacctatccatataacagaatgtataacaccagcataatagccactcaaattcatagccattaataatttttgtccccacaatatagctattgataagaaaactccaaacatagaactaccaactaccgtaaataaccatatgtttcttacctgtagtatttcaacaatatgtttaaacacttgtaataataattttatgatatttgtattcccactttttactagatatgttgacttcgtactattttttagaaacaacgtaaaaatgagtataataatttcagcatattctatatacctaatgatatctctccaagataaccctgacaaagtcaaatatgtatagatatattccattaataaagaagataaactatacactgtttgaactagtccaaacataatccctgactttaaaggggaaaaaaacttataactaatataacctgcacctacaaagccaaaagatgcccctaatgctaaaaaaatctgcgatacaaaaaaacaaatagtataatcagcatgagcaaataaaaaagttcctatagatgttaatataacagatattgatagtacttttttttcattataacaatctaatattgaaccagtaaatagctgaaaaatggaaaaacaccacatatgaattgatgccgctaatgcagtttgtgcaacatttaaatttaaatcttcacctacatatgaatttactatagcataagctatttgaaaattactcccacaaataagtactaatacccctataatccaatttaaaataggataaaaacacatttacattatcttcataaattattaacaaaaattttctagaactacttataaatccaaacataacttttagcgtagtaattataatattaaccaagttaaacacattataaaattacgatacgccaactaatgctcactacttaatatcaattttacaagattcagtatctaataagttttaagattactttaacctgatacaaaatacttaatcaatttatattattgaacatacaatttataatcattttagatctataaaccctatattaatttatacctaataacaacaactatcctataattagcttgataattaaaccaagtactattaatgcccatataacatctctactaatacttgtttttgctttacttagctcttgatagttatttattaaatctaaacttttatcaacttttttcataaataaaggaacatcatgtatagcttgacacaagtaagatctttttaatttttgaatatatttatttttttcaatagcatacttttccatccataattccgctattttccacatattaacttcaggacacaattgcctacatacaccttctatcaatactgtagttttttgtaatagaaaaagttggggttgcaatttcatattaaaatcagcagtaactttaaataattgagttaataatgctgaaatagatatattttccgtatttttaccaactataggttcacctatagcacaacaagctgtaacaaaattactatattttgcatcaacatatccagctctataatggatatcagcaacatattgataatctctttttaagaaacctacaagtatctctgtaacatacatacatgtagctttatctaacctccccacaattccaaaatctataattacaactcttccctttgcatctaccataagatttcctggatgcatatctgcatgaaaaaatctatctctatacacttgattacaaaaacaaaagattaaattttccactagtgctttacaattctctgacttgtaaacattatatattggtacagcatctatccattctaatgtcaatacacgtcttgtagtcctagtccaatctacttctggtacataacatcccttatcactctgaatattagatctcaactcctcagcatttgctgcttcaaaacgcaaatctatttccattttacatatctcatgaaatgtttgtacaagctgtaataattgaaatcgttgcagactttgaaagttttgtgctacccttgcaagccaaaacattaatttaatatcccgttcaaaaattttttcaatgcgtggtctcaaaaccttcacagcccttacattgccattaatatctttagccttatgtacctgtgcaatagatgcagcagcaatagggttctgctcaaattcacaaaacacttcatttatcttacacttaaaatcctcctctacaatttttacaacatctacataaggaaaagctggtaatttatcacataaacagagcagatgacttgcaatttcttccccaataatatcagtcctagaagatatagattgaccaaatttaataaaaattgggccaagtttttgcatagccattgcaatcttctctcctcgagattttttcctaattgatcttttagcaaaaagataggtataaggtaatatgttataccttactaaaacacttaatatattcagtaaagaaattatattagagaaggtactaagcataagatgaaaacatttttaagaacttttcattttttacaatctcacttggagatccttcacaataaatactcctattaatacatataacacgataagaatttgacattacaaaatgtaaatcatgagaagtcataattacacttaaattatatatagaaatcaatttgttgatcaatttgtaaaagctatcttttgcattaacatccatacaactcactggttcatctagaataattatatcaggatttaacatcaaacatcttgcaagtaaaactaattgtaattccccatgagatatctccgacatttgccgatctaatattttttcaatattaatgtcttttaatacatcacttaacttcaattttcttttgctctttgtataactagaatttaaaaaatattttactgtcattggaataagagaattcacactaaaatgttgtggcaaatatcctataataaaattttttgcatattttataactcctatataatttctgtatatcccaaccagaatacgaattaatgttgtctttcctcctccgtttggacctaaaattgtaacaatttcaccaaattttacttggaagctaatatcatctataactttttctttagaataaaaaaatgaaagattttcaacatttataatatagttattgacgtactttttatcatatgcaagaatttcacttttatttaataacttatgaaacatacaatccttctcttgctcttttatatattattacatcctactataggatattctgtaccaagaattatagcaactataaacccaatatattcactagttaatgcagtcactaatggtataacaaagccagttcttttaatcaatgaaccagtatcaatacatgattacatgttaaaaccatctgacaaaaggaaattaaaggatagtgatataatattttacgtagatgatcaccttgaaacttttataaacaaaatacaaaacaaaacgttagtcaaactctcagaggtaatagaattattaccatcaagatacgattctaacttttcttataaaattcacacaacatcaaatgatctacacatttggttaagcccagaaaatgcaaaaaatatagtcaatcaaataaaaacggttttatgtaatgcagatccagaaaatgcagaaaagtattccaataatgcaaacttagcattgacacaaattacaaaacaaacagaaaagataaaaagtaccctaagctctgtcaagacaaagccttacatagttacacatgatgcatatcaatattttgaaaaatacttcggattaaattttatagcagctctttcttcaagccatgatacaaatatcagcgtaaaaaggctaatgcatatcaaaaaaattattactcaacacaaaataaaatgtattttttctgaatcttcaaatgataaagtcaagaatttatttctaaaataccaagtaaaatttcaaatacttgaccccataggcaacaccctagcagcaaaagataatgcatattttgacattatgcaaaatattgccaataactttctacagtgtctatcagaggaataacaccacataacgcatctaatataataagcttctatagactactgaagatacacataagaacatattgtataatatatataaaaagggtatatttacagactcaaaccactatgttaagtccatattctctccatggtaaaactcttatagtcctccttcaattatctaccagaaataaatatcagttatataaaacacttccagtgatgactaaaaagtccataagtatcttattacataatataataaattattaagatataatatatcgagatgataaagctgcacttaaagtcccttcgtctaaataatctatttctcctcccataggtataccacaagctaatctagttaccttaatccctagttccttaaccatttgagttatataatgagtagtaacctgtccatccatagtatttcctatccctataatcacttcttgtacattaaatttttttattctttctacaatactatccaaattcaattgatcaggtcctatcccataaattgcagacaaagtccctcctaatacatggtacacaccttgatatatttttcctttttcaaatgcccataaatctcctagttcttctactatacataacaactgatgatcacgtttagtatcagaacaaatgctacatggtgacttaacatctatattaaaacatacaggacactccttagcctgaaacgctaaatcctgaattcctgatgctaaaggcaacataatttcttctttgttacgaagtaaatgaagtacaattcttctagaagaagatggcccaaaactaggaagttttgcaaacatagcaattaacttattaatatccacaccacctccttaacaattgataagctaaacaacatcatataacacaaaatgcccatatggtatttacaatcaactatctaactcaaaaaaacctacaatgtaacaatgtactttttattataaaataataaacaagctatcatctatacaaaaagttaaagaatatcaaaatttatgtgacaaactatattagaaaaacctaacatacaacatcacaaaaaaactttatacacctagctaacggtttggttcgtcttccgttgatgcaaacttattatctttcaattcttgttttagattacgaatacctttgcctaagtcactcataacctctggtaatctgcctgcaccaaacaatactaaaattattattaaaattaaaaaaatttgccatggacctaaagtcataatagaactcctataaaatataaaactataccttaaataataaaattttatttaagtcaagcaagataaatatagtatcaccaacttgtggtaaaactacattagcaaacctcatccaacacaaacaatcacctacacaaacacagatcatattattaaaaaattttatctgttttactacagcttttactcctttatctgaatcagaaattattgcctcaggtcttatacaaactactactttttctccattagtaaaagattgtgctggtattttccctatcggtaattctatacaagaatccttcactgtacaaacaaaacgattaatctcaccgaaaaactgtgctaacatatgatctttgggactataatatatctcatatggggtaccatgctgaactatatatccatcacgcataacatatattatatctgcaacttctaatgcttcctccggatcatgagtaacaagtaatacagtaattcccttagcttttaataatgataacacatgccttctaatattaatccgtaatgctgtatcaagactagaaaatggttcatctaacaatatcacttctggtttctgagcaattgctctagcaattgtaattaactgttgttgtcctccagaaagcatatcaggatacatatctttatatgctaccatattaatagattttaatatatctagtgcaacattaaacttctgtattttaggcaaatttctaacagcaaacattacattttcaataacagtctgatgtggaaataaagaaggatgctgaaatattaagccaacattacgttcttcagttggcatacaaaagttactgctagctaaaattttattatttatatatatggaaccacaatgtaaattctccaacccagcaattaactttagtattgtagacttaccacacccagaagggccaagaagacaaataacttctccttgtttacaactcatactaatattatgcaataaaaattgaccttttttatatttataacagacattgtttaactgtaaacctaccattaatagacctttaacaagcttaatgccatatagaatgaattattcagctgtaactcacatagatatgagtacatttcataaaataaacgtcaatacttcatttagatgttaatctttttttactttcgatgcaagtaatacaaaagtactatattgcaacatattttactaaaatctctttagtacttataattaattactattaaaaaattattagccaataaaattaatgattttataccatataagtgtatactgaaaaaaacagtaagattagttattatccatacaacatttgaggaacgtcatgtttagattcatagtcacaattttactaacattatttatcaatacaaagtgctactctgcaaatctttcaaatcgagttaacatgaaactatctataggatcattagacatgaaaaccaaaaaaattgaagcagctcttcaagtgacaatacaaaatggttggcatatttattacaaaacacctggagatcttggtttaccaacagcttttcaatggcaagacaacacatttaagagcatacatgtacattggcccaaaccattagaacatacagatactgtaggtgacaacacatttcatagtaatatctataaagatattgtaatatttcccatatcattagtactcaaagataacaaacaaaaagaattaaataccactttacgcattagatatgctgtatgcaaagacgtatgtatacctagagaaaaggtaattatattgaaccaacttttacaggattatcaaaaccaacaaactatgcagttaattaacttctggaaaactaaataagtttttaattactaagaacacacgtgcttgagtttctaggttattactatttaactacctatttaaaaaaataaaacacccgatcacaggtttatagtccttagttatctaaactctaattagaaatgtaatacaaaaactataaagactcagtttttaatgaccaagaacacacgtgctcgagtttccaggttattactatttaactacctatttaaaaaaataaaacacccgatcatagattgatagtccttagttatctaaaccctaatcaggaatgtaatataaaaactataaaatttagtttttaatgaccaagaacgcacgtgctcgagtttccaggttattactatttaactacctattaaaaaaataaaacacccgatcatagattgatagtccttagttatctaaaccctaatcaggaatgtaatataaaaactataaaatttagtttttaatgaccaagaacgcacgtgctcgagtttccaggttattactatttaactacctatttaaaaaaataaaacacccgatcatagattgatagtccttagttatctaaaccctaatcaggaatgtaatataaaaactataaaatttagtttttaatgaccaagaacgcacgtgctcgagtttctaggctattactatttaactacctatttgaaaaataaagcacttgatcatagactgatagtctttacttgtctgaactttaatcaggaatgtaatataaaaactataaagattcagaattacattgctagtaaatataataaataattaccgtagtaaattctatatacaaaagaatagatatatattaaaaacacaaccataattattaattttaatattaacaggttatctatctgtaattctataagataagtctaaaaatattacattgcacaaggttaccaagtctgttataaattaaaccattcgtatgcatgaaatttactatggatacattgtatcattttccactatgtcctttttccagaaaagtacgcatctttctcaaagaaaaaaaatttaactttcatcagatagaagaaaacccctggaaaaaacgtgaagagtttataaaaatcaaccctgtatgtcaggtccccgtattaatcagtggacaacatgtgattgcagatagccaagcaatttgtgaatacattgaagaattatatgatagtatatcactacttgggaattcactatacataaggtcaacagtgcgcaagttaatatactggattgactataaattttatcatgaaattacaagatatatcataaatgaaaaagtatcaaagtattatataaaaaatgctagtccagattctaggtttatccaagcagcaagacaaaatttattgcctcatataaggtacatagaaagattactcaataataatagttggattgcttgcaatgaatttactttagcagatataacattagctgcacacatatcagttttagatttcatgaatatttttccatggcattcaacagccatattaaaagaatggtattccgtaataaagtctaaaccatcatttagcgatatattaaatgacaaagtaataggtataacacctcctgtacattacaatcaactggatttctaaactatgcttttcttattttttaactaggtgaagtacactaggtattaataaaaatattataaatttatgcaattacaaaataaaatgtataacatacaatagtctgtaattttataagcactataaaactttattaatatgaaactaaacctatctaatataaatctaccaaacggatatactttagaacatcacaaaattttatatagtacaaattacgaagcaatcaaacttgcagaatgcggagctgaagatggtacaataatcatatccgataaacaaattaaaggtagaggaagatatgagcgcacatggtactcccccacaggcaatttatatttcagtattattataacaaaattcaaagaaacgttccctttaccatttattgcagcattatctgttggaaaaacactggaagaaatattaataaataacaacaacacaacatcaaaagtagaatataaatggcccaatgatatattagtaaatagtaaaaaaatatcaggtatattgttagaaagtaaaacattgaataacacactacaaaaatggatagtagtcggcataggcatcaatatgtataaagcaccaacatatgcaacaacaatcaaggagcataatcaaaatttcaccctatctaacttagaattactggaaaaagtaataaataatttttacaacttcagaaagcattatatttatcacgggtttgcagatataaggaacctatggctcaaacaaacatgtcatttaaacagagaaataactgttaaaagctacaaacacacttacactggtcaattcattacaatagatacacaaggtaacatgttaatgaaacaaaacgataaaacaatatgcatcacctcaggagaaatatttaatatctaaacctagatgatttataacaatctaataataagacatatgtaacacaccatttataatataaaaaacgctaagctagttatacttaatgtaacataaaattacaatatatcaagtaatatgaacaaatatataataaatttttccacaatattggatagcaaagtaattttatttacatatgtactgataaaaaatactgatgcaatgcctaattaaagagtacttttacaactacaaacacaacattacgaaaatgcatgatacaatggctaatctaacaaataatttcctactatacttaattagaaaacttatatacttttttacaaacaataaaaatgtgatactaatagatagtaacacactaaaaaataaaaatattattgactgaataatatattcaatatagaatgaaggtattatattcaaggttttaattaaatataaatatgttaacgtggcgcgtgagtgcttaaatactaagctagttacttgtaggtgttttactggttgttgtttattatccaagtaatacaataacttggtgaggttttattcatctgccatgtatagatttcaatgcgtgtgtagctgcgttcttttttcttcatcacctttatttattttggttaaatagtcaaaatgcctattattttataaaaagtgcacaggtattatgtttgcacttttaaagtagctgtataacccattaactataaatgcatagtgtagttattaatagaacatttttcaattaacagggagatgagaacatgcaagggggatggacatttaacaatactcaaaggaaattttacaaagacatactgaagcatatacaaaaaaatcaagttgtgaatccaactattagacaaccaataggttatctttcacataagtttgatcagtggctttttgctgtccaaaatactcctcatgaaaagtgtgttataatcactgaggaatgccttaatacaatcattttaaattcaatagactttcaaagctttgcattagtatcagaaaaacttgatgcagattttcaagagcaatgtgatgcacaaggaatactatttttatctggtcttcgcttacaattaacaaaacacattgctaaacaagtaagggatagtggtgtaggagcaatacctttatgtgatattgaaaggctgttaaaccaaaatacaccattaccaattaatttcaatccagcagacattgactgttatagtgatttcgtagatagcatattaaatgccagtaataaagacgttctatatgaagaagcacaaaaagtacttaatatagtagctccactaactccttatattctaataatgagaggtttatcacatgcaattataaaacgtacaaaccctcactcagaaataaatcatgatgaacagcttgttatagaagctaaaacatctattttattacatacaacagctgcaacacaacttacaagagaaactcaagtatctctagctaatgaagcatttgctcatgaacatccagtacaagataaaattattagagcagctaattattttaatacataccttagtagtaccatttcatggacatatattggtagtatactctcagtattcgtaacacgtatgtatgctggatatgctagcagtagagcagaatcagatatacaatctgcattattacaagcacgtcataatgttacttttaatcatacccgcatctatcagcctgatttaaatattaacccaaatcataccaccggaaataacacagttgtttatgcccccagacacccttctgaacaattcccagaacaccaaggcgttctaaatggggctccttcttatgcaacaactctaatgtctacactacagcttacttggacactgcctaatataattctaggacaaaaaaaaagaacgtttattctcaagcatttaaaaaaatatagacctacacaagaagatcgaagaaatgataataagttcttagctacagtaatatttcgctggttcggaaatgtcattatacagcctgttgattgcgtagattctgaacttaaagatgcctttttcagatggactatctttaggttctttacaccacttgcaccaattgaagaaccattaaaaatgcgaggcctttatgctcgtcttaccaggaaatgttaccgaaatcaagaaagagagctccagataagtaacaggattatgaatagtgctagtttagcaatactggcctttgaatatttagatgtagcgctcggatttccgttcccaatatgttcagcaatattaaaaggaacaagaattgcgtcagtggtacttccagtattagtaaacagattacgtgataatataacttataacccaagattcagaaggtttatacttgcaaacatgttaagaacaggatcttcacctcttgtattaacaggttttgacctaatcggtaattcaatacgttacgtgagtttattaacagcatttgatgtaatggcaaccgtaaatgttgatgcagtatcatctagtattttatacgaagctgatgtattagaacaacacatcatgattattgaagatacagtagaaaatattatattcaccaatagaggaagcctagcattacttgccccaagcatggaaataagatttactgactcaagaaatcgaataactattagtgaaatcttagaagaagatgaagaggagttacaaactcgtcgacatgcaactagagagcacaacagtacagaaataatctacaggttaaggggagcaagacgtgtattacatcaggaagtacctggtacaatgcgggacggaatacctctattatcctataggagacgtcacagcagcagcactatagaagaaccaataataggccctgaggaaagagcagcatatttttatgaacaaaatatattgcatccaaacaggaatattgaaacaagaacacaaccaggtacacatcatgtggcatcaaaaaatctactgaattcagacatatatcttgaagcacaaaatccagtaatattaatttctcatacaagacgttctagtgtagacatttcacaagaacaacctgtagtgtttgtagaacaacaagagtcagatgtagatgatcagcctgaaactcctgaactaagagcagcatatttctatcaacaaaatatactgcatccaagaaggaatactgaaacaagcataccaccaggtgtatctcctgcgcgggcaccaacaggtatgctgaatgaaagtatatatcttgaagaacaagaaggagaaaggttaacatcttacagaagatgttctagtatcacacttacagaagaagaatgtgaattacaacaagtaattgtagaacaacaagatccagatagaggtcctcatcctacagatagtgacatcattaatctaagagcaacatatttctatcaacaaaatatactgcatccaaggagggatactgaaacaagcacaacaccaggtgtatatcatgtgcgggcaccagtaaatatgctgaatgcagatatatatcttgaagaacaaaatgaaggacagttaacatcttatacaagacattccggcactacatcttctaatcaaggaagatcaagaagatcaggtagaagtgccttaaatgaaccattaccagactctcagataagacaagcctttttctctcaactacatccaagaagaagatcaggtgatccattacaggatataataccagaaagtatgatgcaagcagagatacttctagatccagaagaggatcctccattactatttggtagaaacattcctacatgcagtattacagaaatcataactgaagaaagtgatacctcaacacagcaagcagctggagctactgcaactcctatcggaggcgcagatgatgatgataatacattaccaagttcaacacttcacgtctcttctgctacacaccacggtgctcctttatcaagataatgttatacaacatagaaggcctgaatgaaattgtaaaaccaagttcattcaggtttcctaaatctcttaactcttctttattaagatagcataaaggtacttactttctctgaaaaagtcctgaatgaaagtataaagtctaagtagatgattcaagtctttttgtaaagtactgcactcctcattatcctacataacattgttatcaattcttacaaaaatcaatagcatgtataccaccaagaaatacacataataagtacatattttctataattggacaaccaataaaaatgcagagagcatacaacaataggaacatttacatcattaacacacagatatttttataacaaccaactaataaacaaagtagtaacatcttggtacacagtaatcaaattgtacattcaacaatatcccacataacattgttatcaatactattaaaacagtaaaaaggtattaatgactatattaaaatacctgagtaaacataaatcctatgatttaactctctttacaaactgtcaaattctttattatcaagatagtaaaaatactctagctataatattgaaaaagacttcaatgaaattattaaattttatattttttcattacatttttaagtctatcaatttttaacaacagatgataatataagataaaataaccttttacacatcacatactaataaactacagttaacattaatttctctggaccacaacataaagatttagaacttcagaataaataaaaacaacaaagtaacttcttcgttacagaaatggatcaagaaaagggattcgaatcctcgacctttattttggcaaggtaacactttaccaattttaacaacagataataacataagtaaaataaccttttacacataacacactaatcaactatagttaacattaatttctggaccacaatataaagatttagaacttcagaataaataaaaacaacaaagtaacttcttcgttacagaaatggatcaagaaaagggattcgaatcctcgacctttattttggcaaggtaacactttaccaattttaacaacagataataacataagtaaaataaccttttacacataacacactaatcaactatagttaacattaatttctggaccacaatataaagatttagaacttcagaataaataaaaacaacaaagtaacttcttcgttacagaaatggagcgggaaaaggggttcgaaccctcgacctttaccttggcaaggtaacgctctaccaactaagctactcccgcacaatcttcaagtattattttggagtttaatgataaaataataactgtaacagtgcaagaaaattataataacccttccataatatctcacaataaaaactgcaaaacttaaaatttactacgataataagaaaataatgcctaaaagtacaaattggtataatattaccaccatcatacttcaagtgttattagatattatatatcaaataacatctaaacatttacaataaaaatatattaaaacctcggagacaaacaaatgatcaaacgttacagtagacctgaaatgtcatcaatttgggaagacaataataagttcaaaatatggatggacatagaatactacgcatgcgaagcacaagcaaaattaggtgttatacctgatcacatactcaataatttaaaaaacaaaattgaacattttgatattaaccgcataaatgaaatcgagtcagtagtaaaacacgacgtaatagcatttttaacatatatatcagaatctaccaatgcagatataagatacttacactacggtatgacaagctctgatgtattagatacttgcttatccatacaattaaagcaatcttgtaatttattattagataacatagaaatcatattaaacattttaaaacaaaaatctatagaaacaaaatatatattatgcatgggacgtagtcatggcgtacatgcagaaccagtaacatttggattaaaacttgcaagattttacgcagaatttaagcgtaattacaacagattaaaaatggctcaagatgaaatatcagtatgtaagatttctggagctatgggtaactttgccaacattgatccatttgttgaaaattatgtagcaaatgcattaaatcttagaccagaatctatatcatcacaagtaataccaagagatcgccatgctatgttttttgcaactttaggagttattgcatcttccatagaaaacatagcaatagaaattcgtcaccttcaaaaaactgaaacactagaagtcacagaatatttttcagctggacagaaaggaagttctgcaatgcctcacaagaaaaaccccatattaagtgaaaatcttacaggccttgccagaatgatacgaagttacgtaattcctgctctagaaaatgttgctttatggcacgaaagagatatatcacattcctctgtagaaagatgtattgcaccagatgcttgtattgttacagattttgcattagcaaggttagcaaatttgctcaataacatgatcatatatcctaataatatggataagaatctagcacaatcaaaaggtttagtattctctcaacgggtacttcttgaattagtaaaatatgggttaaaaagagaaacagcttatcaaataattcaagaacgggcattaaaaacatggaataacgatagccattttctagatgaactaaaaaaagatccacaagtattaaaatgtataagtaacgaaagtttagaatctttatttaactttgattattatacacaacatatagacacaatattcgataaggtttttaaagaataaataattaattaagttcagtttttaatgttaattaatatataaagtcattatgaagctactaagttattaatttttaaactaaatattaaaaaatataagatctttagttaagcaaattgttaattagttaaaaaaacaattaaataaaatatgaataatgtaattttatattaaaataataaataattgttattgactatttatcattttctgattacaatcctattatattaatttaaaagattaataaatacggtcctaccttactatcaatgcataaccattaggtaacacacactttatcttacaaaggtaaggtagggcctctatctaatttagacacaaactagtttaactacacacatgcctaattttatacatttctacagtttattgcaagtggtttttatacaaccaaaagttataaccaaaagaattaaacaattataaagaaagttgttgttactacttaaaccctacgcaacttattacaaacaacctttcctttttaacaaaaatcactaagattacccagcttcttttcaagaagtatatacactgaatttaataatagatgatttaaaaaccattcacaataatcaatctattaacattcatatttctgctataccattttcacatcatcaagtacgtattgcgtacctatttctaatacagtaccaatacatgcctaaaatcactctctaaatacgatatatctttagtataaacccatctctgacatacctcttcaaaaacacatatctagttacctacaaatagtcatgtatataatactatagtcagattaagccatatctaagagctattgataaaccttagccaatatattattcattctttcagcaaaatcactaacatcctgtagctcttctccttcaagaatacatgcttgattcaataataaatgcaacatgttttctaatgtaacactttccccagcattagcatgttcatctatcattttagtaacaataggatgtttaggattgatctccaaaatctttgtgctcttataattcaattgcttctgttcccttaaaaatctttccattctaatatccatggaaccatccgctacagctaaacatactgggctatttgttaattttttcgataccctaacgctactgactaatttatcaagtacttgagctgcatacttaacaaatgtgtctactttttctttagaatcaacgctctcatcttcattttccttaatttcttcactcttatcaagatgagcaagtttttctaaatcttcatccgctcgtataactgattttaaaggcaccttttgataatcagttaccacattcgtccaaaaatcatctacaggatcaactaacagtataacttctatcccgcgacttataaacccttccagttgaggactctttttcacagaatctaaatcattaccagttaaataataaatattatcctgccctgctttcattctttcaatataatcttccaagctaattaacgaatcatcactgtatgtactataaaaacgacatgctgacattaactcttcacgaaactctgtgttcatcgattcacacaatccttccttcaatactgagccaaaattttcccaaaattttttataatctttaatatcactctcagcttttttcttaagttcagatagtactctattaactatagattgttttatcttctcaataattttgttattttgtaaagtttcacggctgatatttaaaggtaggtctgaagaatctattataccttttaaaaatctcaaatactgaggtataatttgtacattatcttcagtaatgaatactttattcacatataattttactgaacatttcctatcaggatgaaataaatcaaatggtttaatagatggtatatacaataaattagtgtactctactaccccttcatttttattatgtaatatcatccaaggttcaccaccaacatgagctactgtacggaaaaaattttgatgttcttctgcagatatttcacctttagattttgtccaaatagcagcatcactatttaacttctcttcttctcccttatcatttaagaaataaactggataattaatatggtaagaatatgtagtaataatatgttctatacgaaacctatcagtaaattcagattcttcaggctttaatattaaagtaatcttagttccacgggaaatttgattatcctccagttgagaaatagtaaattctccatctccatgagatttccactgataccctatagattctccagctttacgagactcaactataacctcacttgccaccataaatgcagaataaaaacctacaccaaatttacctattagttcaacaacaccttgagaagaagttccattattaatttcatccaaaaacctttgtgtaccagaatgcgctatggtacctaaattatctattaggtcttgcctattcattccaataccattatcagatatatataatctatttttatcttggtctacactgataactattttaaaatcagaatcttggtctattaaatcttgattagatagagattcataacgtaacttatcacatgcatctgaagcattagaaactaattctcttaaaaaaatatccttatttgtataaagagagtgtataacaagctttaacaccttacctacttcggcatcaaacttcaatttctcagaatttataacatcttgcatattaaccctcttaaactagtattaaataaataagtaataactacagcaacaattttcaagttattaaattactaattctcataaatttgtagtaaatccatagcatgcttatacaccataagctcagaatctgcattaccaactatctcttttattacctcgatagcaccatctatattattattttttagcatatacactgctattgcttctttaatagatgacttataaacttcagattttgtagacaaaaatttctgaactttacttttcaataaatctaaatcctctcctttaagcaatgctataatctccaaatactctgctaactccctcaactcaggcatgagtcttttatcagcagctaaatcagcatatattgactgtgcttttgctacttcattctccccatacatacctgctaacttaaacttagctaagtactggtagttagaaccatcaactttagcaacatcattcaatatttttatcatttcatgttcactaacttcacccattaaagcatcatacatcatatcacccatacgttgtgataacttctcatgacggttatttacccatgaaaccatccctgcaaacactactaataagacaactataataccacatatccacttcatatttggaacaactttaactatgtttaaccccataaaatgtccaatcaactaacaagataatatcaatgtaaaaaaataaatgtgcatagtcaatgcattttaggaagttatcataaacactgtataacacatatccttttgatgtacatatattcattttaatactagcaaaagtatatgtataaaccatttatacccagacaaactttgacttaagcaaattacacaatacctttcttgatcaacatactcgttatgcaatattaatcagcaatgtaatacacttagcgtaacactttagcaagttcataaacttttactttcatatttacataaatcttgaacaacacactaactacacaacggctttcttgacttacacacatatctatcatgcaatattaatcaaataatacacttaacatcacactctagcaagttcataaacttttactttcatattcacataaatcttgaacaacacactgactacacaatggctttcttgacttacacacatgtctatcatgcaatattaaccaagtaatacacttaacatcacactctagcaagttcataaacttttactttcatattcacataaatcttgaacaacacactgactacacaatggctttcttgacttacacacatacctaccatgtaatactaaccaatgatgcgcatataataaccacttttttggtattacatttaacaacgcgtcctctgtctttaatacattactttccttaactaatcctatcctattacttactctaaacacatgagtatcaacagcaacagttggtaaatttaaccatgtatttaaaaaaacattagcactttttctacctacacccggtaatgcaacaagagtattaaaatctaaaggtacattactattgtgttgatttataataattccgctaagtgcaataatattcttagatttagaattatataatcctattgtatttatataattttttagtcctttttctccaagatctaacatttttcttggagtatcagcaacttcaaatagtttatctgtaatcttatttacactaacatcagtagtacgtgcagataaaactattgctattagtaaagtaaaactattagtatacttcagttctattctggggtgaggattatgctccttaaatttagtaaagagtaaatttatattccttcgattcattaatctgcatacacaacttatatattaccatcaatatcagaattatccttagcatcaattatctttgctactgaaacaactttttcacgtttctcagtcttaaataaagtaacaccttgagtacttctaccaataattctgatatcacttacagcaatacgaattagcttacctttatctgtaattaacattatatgatcattagattctacaggaaaactagctaccacattgccattccttgcagttgtcaaaatattaacaacacctactccccctctcaaagtagtgcgatattcatatgcagaagttctttttccaaagccattttcagttactgttaaaataaattgttcattttgtaccatagtaacaaatatgtcttgttctaatccaagatcacataatatcttagctatacctccattaacaacaccttcctctttaacacacatacgcttgtctaaaggaacttttaaatacagatcctttttctcagaatctatatccatagctagcaatacagacatagaaatgacattatcatctgaagatagcttaatagctcttaccccatcagacattctgcccttaaactgacgaacattacttacagaaaacctaatacttttccctaaccttgtagacaataaaacatgatcctcttccttacataccttcacagatatcaaagtatctcctgtatcaagtaccatagctattttaccgttactaggtacatattgaaaatctgaaagtgcattacgtcttaaattacctgatgcagttgcaaaaacaatattcaatatttccgcatcttctacattatcaggtaaaggcataacactagttatagattcattctcactcagcggaaaaatatttactaatgatcttccacgtgatgtaggttcacctaatggaagcttataaaccttcaacttatatactctaccaatattagaaaagaacaatacactagtatgagtattaactacaaaaagattagttattacatcttcttccttaatagcctgtcctattctcccctttccacctcttttctgagctcgataatttgaaagcttagcacgtttaatataaccactcatagtgacagtaactaccatatcttcttttggtataagatcttcaatatcggtctcaaaatgtgaataatctatagtagttctcctaggaacagctaattttgctttaatctctttaaacccatccttaatcaattgtaataaagactctttgtttttaagaagctcagtatactgtttaatcatcgataccattgactttaagtcaagttccaatttttccttttccaggtttgtgagacgctgtaatttcatttccagtatcgattttacttgtacacctgttaattgacatacattgtcaatgacaatgcttttactatcggcaacaagttctatcatctctctaacagatgttagagcatcccacttacattcaagtaaccgcttagtagcctctgctgtgtcacgagatgatctaataatagcaataactttgtcaatatttaacacagcaatgtacatgcctatatataaatgagctctttcccgaacctttcttaatctaaactgggtacgacgtgttaaaacttcctttctatactcaacaaacgtagatataatgtctggtaaagacatcacttttggtttattattatctaatacaagcgtattaatactaaagctcgttctcaatggagttaatcctaaaatttgatttaagataacctgatgagacacctgtttctttaattcaattgcaactcgtatccccattttgttagattcatctcgtaaatctaatatcccttctatctttttttctttgatcagttcatggatacgctcaataagttttgccttatttacctgataaggaatttcatcaataattattgcttgctttccagacggtaaatcttctaaatgagttttcccctgaataataattgttcctttacctgtcataaatgcagaacgtataccagcatcccctaaaatagtaccaccagtaggaaaatcaggaccacgaactatattaattaactcatcaaaagtaatttcaggattatctatgtaagctatacaagcatctattacttcccctaaattgtgagaaggaatattggttgacataccaacagcaacaccaccagctccattaaccagtatattaggaaattctgctggtaatactacaggctctacttcattctcatcataattaggccgaaaatctacagtatcttcatctatgtcatttaataaaaaatgtgctgccttcgccaatctagcttctgtataacgcatagaagctggaggatcaccatctattgaaccaaaattaccctgactatcaattaacggcaatagcaaagaaaaatcctgcgccattcttactaatgaatcataaattgccgcatctgcatgaggatgatatttccccataacatcaccaacaacacgtgctgcttttttatacggcttaccataatcataaccagacttatacatagaatacaaaatccttctatgcacaggttttaatccatctcgtatatcaggaatcgccctactaactataacgctcattgcgtaagataagtaagaatcttctaattcttgttctatagaaaccggtatgacattattgacatcactcatctaatacttattaactaaccttaaaatatatcacacatcttaattcccaagcacatcaaggtcaagtaattgtttccaaaaacaaccaactaacattgctactaaaaacatcatataacccaaaatgagctgttcctcctgctatacaaccacaccaagtatttgtattgcacaaccattattacttcaacttaaaatttaaactaaaacagacaaaacatatttattattttgtgatgaggtctattctatattaaaagcgtaaccacattaaaaaacacaggtattacaaattaataatgtgtcattattgcataaaaatatctaaatttaattactactattttttaacaaatatacaccaatatactattgtcacgctatatttcatcacattaacaaaccgttctcaaaaatataatattaagatcttactttgactgtaccagaaaaaaaatataatatactccagataatgatgaatttattgcattatggaagattatataacttcacttaatgaagaccagagggaagctgtcattaatataaatggtcctattttaatattagccggagcaggtacaggtaaaactagaactattacttcaagaatagcatacatcattaataacaattttgcattacctagccaaattttagcagtaacatttactaataaagcagcaaacgaaatgctatctagaattagtgaattaacacctgtatataatatctggttaggaacttttcatgcaatagcagcaaaaatcttaagacagcatgctgaagtagttggattaaaaaacgattttacaatcattaacacagacgaccaactacaagtaataaaaaatattgtcaatgacatgcatcccgaatatgcatcagatgcccataaaattatcttaaataaaatacaaagatggaaagatagaggacttataccaagcaatattactgaaacagagttatataaacctattaatacagtagcattgagtacatatcacatttatcaagaaagattaaaatttttaaactgcgttgattttggagacttactactatacaacattcaaatattcactacacaacataatgtcttatcccattaccaagaacaatttaaatacataatggttgatgaatatcaggacataaatacaattcaatatttatggttaagattattagctcaaaaatacaaaaatctatgctgtgttggagatgatgaccaatcaatatatagttggcggggagcagaagtaggaaatattttaaaattttctgatgattttccaaatgcaaaaattgttcgattagaatgtaactacagatcaacatctaatatattagacgttgccacagcgataataaataacaataaatcaaggttaggaaaaaagctatggacaacaaacgagaaaggacaaaaagttaatttaatgaaattttgggatagtaaagcagaagcacagtatatatgtgaatatattaaaaatttacatgactaccaatttaacgagacagctattttagtaagggcaggatttcaaacaagaatattcgaggaatacttcattaaatatagcataccatataagataattggtggtacaagattctacgatagacaagaaattcgtgatatcatcgcctatttaaaaattacagttaaccctaataatgacatcgcttttgaaagaataattaataaacctaaacgacatataggagcatcaactcttaataaaatatacttatgtgctaaacaaaataatacatattttttgaacgcagcaaaaattctaatttcaaataatcaactacctgacaaagcatcccgatctttaaataacttattaaataagattgactcttggaaagaatctttatcatctgattcaatatcaaacactgttaaaatgatagcttacgactcaggatatgtagacatgttagaaaacgaaggtgaaaatggtttagcaagaatagaaaacataaaagaacttttttctgcattattaagttttaatgatgtaaatgaatttttagaacacatcagccttgtaacagaaacagactcattaaattacaatgacaactacacatatattatgacattacatgcagcaaaaggattagaattccctatagtttttctacctggatgggaagaaggagtatttccacatgaaaaatctttacaagacagaacaggagaagcactagaagaagagagaagactcgcctatgttgggattacacgagcacgtgaacaactatttatatcatgcgtagcagtaagagatattaacaactggcgccagcaaatgaaaatatcaagatttataaaggaattacctgcagaacatgtacaagttataaaaaatatttctagctattattaattattaagttttgtgaatcggttaatgctaataacagcattatgtaacagtatagaattctttaccatttcaacacatagggtatgatgtgcaacactaaccacatttttatacataatttataatcctttcgcgtcatttaatatatacacgataatacattcattaattgttaaagaattacatctatactacttacagtatttattataaagaatctccaatgctaaatcaattaagatccgcgatgcgcagattaactatgccatcatttatgcaatccttaaaaggcttcagtgttcagggtattagaaatacaaaatatactgaatgtacaagtggtgaacaagcctggaaggatatgtcaagaaacgacatatcaataaatggacagaatactaacattaatcaactaattgatcggtataacaaagagaatccacgaccacaaggcaatgaatatcgtacaatcttacattcaatgcttaattcgacgttttatcggtactctggacaaaagattaaccctgctcttcgtgacgaatgtataacaatgttaaatcaaacatctttgcatggttcactatatacacagataatgcatagtgctggaaaagatatacagcacagaatatatcctaataacagtattataccggccccacaatgttatgatactaaaatcaaagtaatttcaaactcaacattaaaggtacagtatcaggaaacaataaactttagagacatagcatcaggagatactgtatgcactgttaaggggaaactgtcattctatgtcagcgcaaatgaacacggtcacatattatataattctcctaaaatatcactgcaattaccagcacaaatatcatcagccctagttcctaggggcagggttttcatgagtaacatgttcactcctctaagtaatatagtaggtaggataaatgcattttttactaatactccttttcagaaaacaactccatacaagataacacgtggtaacgatatagctaggatagaatatagtttacaaaattacgcatgcttaccagtatcaatggaaatacaagatcaaaaagaagaaaatcaggagaagcagatacaacaacaagctcaacacgatatgtttgaggacattccactggacacagaagatcaaaaagaagaaaatcaggagcaacagacacaacaacaagctcaatacgatatatttgaggacattccactggatacagaagatcaaaaagaagaaaatcaggaggagcagatacaacaacaagctcaacacaatacatctcagaacatgcaagcagataatacaaattcaaaaaacagtaaacaaaatgtcagcaacaaaattactgtttccgcaattgtacatgcaccacaacaaaacaataatacacctacctcttctcgctctgtataacaatagttctctaatataaaatgtataatctcttctacactttcaaaatcctgacttcacttaaaacctacagataaatttactcctttatttgtcgcaaaaatcgaactaatccccaatacttctatcatgaaaaccgtgaaatacctataattcactcatcacaaaatagtaaaataaacatttatgttcatccacaagtacaaaactatataaaactatacccaagctaaaactccatatactccaaaaataataatacatattttattcaaaaacactcatcaaaataacaccaatatatctcattaccacttacattatataaaatatataaaatttaaataaaaagattaatttattataaataatatgctaaagtaaacgtaaatatacatagtgtggcatatgaacaataccattttaacaatcataatcatcatagcattaataatactgatgattgttcttctatcatttatcttttgcgctattaataacagatctcacaaggtattctttgataaacaattacccaacatatctagagattttatacaaacaatattttacccagaaaataacaaccaactaaacataacaaatctatcgcacaaaattcttagcaaccaattagcggttagtatgcctaatcttgacgaaaatttatttaaacagttacctagaatattaaaattttaccaatcacaagatacatccaatacatacattaaccaacattttcaatatatagtacaatcgttaggtataaaaacgaactataacaaccttaaaacatatcatcctaaaattgctttagctgcaaccttagataatatgtttacagtcctaaataactcagaaattagcccagatataatacatgaaattgtcaatcatttccatcaagaggtatatgaacaagcaggaattaaaatattaaataacatttttaatacagataaaaaccctactaatattattaaacctgtaaaccatattatacaatttgcagtatataactataatctaataactataagcataattagcaatatgtcattattcgacactgcaaagcctaataaggtacattcttttagtagcgttttccatttcaatatgttattaagaaaaaacccacgaacaaacagaagctctatatcatataatcaaacaacctttactttattcattcctaatagtattaaacattacattacaaaagaaaagtgtaacacacaatgtatgcaaccttcttctataacacaagatcctgattgtgccacattacattattacaacacaagtaattctcatacttctaccttagaatatcgcttaccaaacccaaaagccaaaccattatttcaaaacagaagagataatatacagatctaatagatattactacaaattaaacattctaataaaaaaggaaccaataaaaagtgctataaaacacatatgtatacttatacaccaatattaaaattagttaaaacataatacataaaatgataacactctcacaactataacagctatattagatacagaaacaactatttaatattcattaacaatacaatataaactactaaatttagtactgtattaattactttaaataaacccatataaatattacggaatattaaaaagaaaagtaaacctatattaatcaatttcctggaaaattagtaagaatattatgaattaatatattcactttttttaatctattagttaattaaataatctttaaaaataatatttgtaaactatccttgtaaaatatttaatattgtaatataatttaacaataaattttattaataatttaaatattagtctagtatataaaaaacttaggtataaaaacatgagtcacaatttttcaatagaaattgctgtaatagcattattgtctgtaatgttaatcatatttctagcagttgctacgttttactacctacgcaacaagcaatcaacattgttcaaaaaatatatacccatgtcagaagaaacaatgaagcaatcaatttttgcacttcctattcaaaaccgaccaaatagtgccgctacacagggtaaaacatcacacctagatttccatcgtattcagtatactatcaatggtatgaaagtccatgctgcaacattttttacccaatataatacattagaatcaaccataaagtccggaaatatgacatctgactgtaatgttattaggctagcaaacaaacataaagaagccataaaacaagcattagatatagatgataaaacatgtcgcgacatgttttaccacaggatagcaatggccacaatttttgaattaattttcgacacaaacactggagtggttcccaacataaatataacacatgaaatagtaagccattgtaatcaagcaggaaatttcgctatgccagcaatgttctttgaaaaaattttaaaaacatgtaaagaatttaatattactaaaacaaagattaaagatctaaaggcatcacttacaatagaaaacagtaatgaaataacatgtactattagcacacacactaaaatatacaagcataaccaaactcagggatacgttttaccattcaaattaacatttacgatgatgccagaaaatagtcacagcttttcagatatgttatacaaaaacattactttagaagtaacagtacctgacacaatacaaaagtatattacaaacaacactactagtagtaaaattgagagtaacagaatcacattaactaatatgtgcagaaattcagaaggtaatacacaccttacatattctttaccaaatttaaaaattccttcattaattaataaatcaagtttcggtgctatagtaaagcataactatgaatctgttgaaagttgctcaccagtagtacagcatcaaacacatcattaaacacttgtattcaaatttccaaagtagcctgtacttttttacacaatacaagttttctactacataattataattgaatttacatttgctatattaattataaagaattattattgttttttttcattattttaatatacttaaatattatagttaaatgattaatgttttataactctaagaaatactatagaagtacaatattatggactaccttagtagcatagcaataactttaatattattaattatagtttttatagtaatactaattatagcacttcgtatttttaaagatagtaaaattgacacaatagaaatttttcaacagcacttgacttctatgtcacaagaaaatgtattacaagttatgttccctactaccaagcaaacaataaatactgacatcattaattgtaacgcatttcttactgatatctgccgcactgatatcactattcagaataccaaaattaaccgcgatagaataaaaaatatactttcaggttacattaacacacaacaaagtactaaattaacagataaacattcatcatacttatcaaatataagtaatacaaatcttcgtaatagaactcttgcagctgcaattttagaacaaatgtgctcaaatgtaaaacctaatatagtaataaaagaaagcattatacacgagttaatcagctgtttacatcaaggatgttttttcagcatttcgtacaaaataatcaatagcatttttaataaaggttcagaagaagatccaaactatattgtacgaggcagaaacactaacacatcaattaaaataaaaaacagtcatataataatttgtgacattaaaaatgatatacttataaatgataaaggtaatgttgatacagcaaaatatatacttacaagcaaactaactttttcaatatcatcaaatccaaagaacagttacagtcctatttcatacaaagatataaaattaacattacactttcctaaaaacatgagacaatacatcacaagtgaaaaaccagtaaggaacgtacaagaaaatttacctcatgctgtcttagtaaaaaaaagcaggaacacattagtatatcaactaccaagctttacatctaacagcatactactagaatattacaacaaacttctacaaaatgcagagagtatacaaccactagaacatttacatcattaacacacagacattcttataacatacaacagccaactaacaaacaaagcagcaactgttacatcagtaatcaaaatgtacattcaacaataccctacataacattgttatcagttctgacaaaaatcaatagcaccttatcaccaacaaatacacattaatatgtacatattttctataattagataactaataaaaatgcagagatcatacaaacaacaaaaacatttacatcattaacacacaaacatttttataacatataacagccaactaacaaacaaagcagcaactgttacatcagtaatcaaaatgtacattcaacaataccctacataacattgttatcagttctgacaaaaatcaatagcaccttatcaccaacaaatacacattaatatgtacatattttctataattagataactaataaaaatgcagagatcatacaaacaacaaaaacatttacatcattaacacacaaacatttttataacatataacagccaactaataaacaaagcagcaactgttagtacatcagtaatcaaagtgtacattcaacaataccctacataacattgttatcagttctgacaaaaatcaatagcatttatatcaccaagaaatacacattaatatgtacatattttctataattagataactaataaaaatgcagagagtatacacaaacaacaaaaatatttacatcataacacacagacatttttataacatataacagccaactaataaacaaagcagtaactgttagtacatcagtaatcaaagtgtacattcaacaataccctacataacattgttatcagttctgacaaaaatcaatagcatttatatcaccaagaaatacacattaatatgtacatattttctataattagataattaataaaaatgattaaacttattaagatatatagaaacatcaaggttatttacactacatctataaactgcaacattttcaaaaaaagaagacatagttactacttaataatttattccacagtatctaacaaaatcattccaaacactaaaatacatacttgaaataatgagttacaaccaatacaaaatatcaatgcagtttttttattaataatgttaagagaaacatttagcacaacatatatttttcacatgttgtgtaatcacattaccatcactaaaatcacctatacacaccttacatagtgacaccgtaatactttataaagataaaattagcaatattataataacatttataattaatactgcaattttaataacactaaacaataatatatgttattttttaatcaattaatacaatcttctatagggtattcttctgattatctatacttaacaccaaataacccaccagctatcagacgatacaacaatatagaatttcttcaaataaaaagtttgtctacacaagagatagaagaaattataaaatcaatattaaaagcagaagagtatcaaaaatgcatgacacaaggattttctaatactacacttgcttttgatgattcttaccaattacatatacatattttatatactgctacccagtcttttaaaattatagttaatattatacaaaatgaactcatagtaacaccagagtttgaaaaagaattacacagaataattagtatatgttcaaaaggattactattatttactggaaacatatgtaatgacaacaccgcattatttatattgaatcaaattaatgataaccaaaaaaagcacgtactaatcttcagtaatgatacaatacctgtcccaaaatccaacaaagcattaattagtatacacaatttaccacaagctgaacctacatttattaaaaaccaagcagcagatattgtatgtttcagtaattttaataatgctaatttagtacgcacagccattacatgtatcaatatgggtctactcgttatagcatttactgacacaatttcatgcttatgcgcactagaaaatattgcaatattatttccacacaaaaaatctattttaaaaatactatcaacacatttaatagctataataacacaagtctttattagagtatcgtctgataacttatatttatatgacataatagaatgcgataccacagtacaacaatacattagagaagataatttatcagaaatcaaaaacttaggtatgattaaaaaaataaaccagcttatagaaaaacatcaagtacattaccatgatgtagcaaatatattaaaaaacctatcagatactaaccaaccatacactgagcctaatcacaatgatcttttttaatcactattgaacatctaagtctaaaattctatactaataactctcaaagtaatattcatatttaattattatatcagtagatatcaatcaggattcatcaatacaatagaatctaattttaatgacaaggcagcgtcattcacatgcaataccaaatacctatacatataagtttgtagtgatacagtaataagtatataaatattttacaacagcacctaaaacaactcttattttataaattattacatatttcatgtatcaaatttacatgttacaatgctaaaaaatactttaataaacaatgcttaatgactttaaaatagacccactagttaaaaataaatcaccctcagcaacaactgcagttgttgctatgtccggcggtgttgatagttcagtagcagcagcattgttacacaaattagggtacaaagttatcggcatcactctacaactatataataatactactggaaaaggtgcatgctgtggtagtctggatacgcaagatgcaaaacaagtagcatcaattatggggttccctcattatactctcaactatgaaaaagtatttaaagaagaagtcatagatgattttatagacacatacatgcagggcaaaactcctataccatgtataaaatgcaatcaagttgtaaaatttagagatctacttaatgcaacaaaatcacttgatgcagatatcctagttaccggtcattatattagaaaaatagaacaagatgatgatatatacgtatattcaagcaaagatacaaaaaaagatcagagttattttctatttgcaactacaatagaacagctaaaatttcttagattcccactaggaaattttcataaagataacataagaaaattagcagaacattttaatctaccaatagcgaataaaccagatagccaaaatatatgtttcgttgcagatacatataaaaatacaatagcacaactaagacctaacgcaataaaaaaaggtaatattatagatactagtggaaacatattgggacaacatgatggtatagtcaattttactattggacaaagaagaggtataggattatcttcaaaggaaccattatatgttatcaaattaaatccagatactaatgaagttacagtgggccacaaatctgcactattgcaaaataagctacacatagaaaaaataaattggttagttaaggacaaaattccacacactggactaaatgttaaagtaaaactaagatcatcccattcaggtagcacagctatagtttatccaaacgataacaataaagcaactgtactattacaagacacatattgcacagtaactcctggacaagcatgtgttatttatgacggagatagaatgttaggaggaggatggatatgttaaacccatcttaattattcctgttaatccggatccaatttgtgatactagttttattcttcgactttctccttcagataatgttcctgattcacgatcgagtgttaaataacctaatttaacattttttaaacatgttagtcttttattgaacttttacaatattttttaatatttactagaaaatcacaaactgaaattttacaattattattaaactagggtttgataacattataataacactaattcattaggatacgaaatcaaaactttattttaataaaaacgttatcaataactatatccacctatatttacaaaactattacattctataaagatacacacaataacgaacgctacacctatttaaaatagtaatcttacataaagtacaatgttttcaaacatcgaaatttcaacctattgttttatagatatttgaccactcctcttgtgaatattggcataggtttttgtattattgacactttaaattaagacgacaacactgcaaacgataatacatcaagtcaacacaaaacgatattaatatccactgtatacttgtgacactcctagtaaaataataccatactagataaatgaaacgtacacttactttttgtagaagatgaatcatcacataactttagaaagacagatagcagctttgcatgccttttttataaaaaaagacaagatactatagttagcagcattaccagaattataacacatagcagtatcatgatgttccagctcttcattacgaaactgaataaccttatcttttaattcaccttcatccaacattgctatttgatcttgataatgatcacttattacatcttccacagcaacagtacaagccatagctgcatcctcacccattaaagccgttgtaatacctaacataactcccataacatgccatactggtaaaaaaactgtaggacgtatttttttatctttcattacagaatcaaaataacgaaaatgcttctgttcttgtttcttcatttcaagaattttctcaccaacagacattttacgaaaaatcaattcttgaccagaatatatacacactgctccatactctccagcatgatttactcgaatagcttgttgcaatagattatctttttgtaacatattgttttacaaataaatagacacttaatactaaacatagcacacaatatataagattgcattctgccatagataatcctataaatacaatactaggacgattacaagatattaccacatttacatctagtaaagcatttttcaggtcatcaaaatttaaagattttatactatctgtacatcctataatatccgctacccaactatgttcaagagcaacatgataacctgagatgcatatattgcatatataacataagcacattataaaaaaaattactttagatgatttaaataaatataagataaacaatccaacagtaataaaatatggtatgcgttcatatatacataacttacaaggaagcattccaaacaaatattgagctatataggctacacccaatgcaacaatacttgctataaataacaaaattacactgtaattttttaccatcttcatcactttacctgaattttagcaaagtaaaaatataactattaagagccactgcatcacgaatagttaagtcaaaacatataaatgctacaagatacataactatcaatgtataaatgactaacactagtccttcaaaaactattgaaaagcaattgttatataatatctgcaaactagagataggccaaggttttattatgtcaagaatattaaaaaacacaaaagggatcaaaaagaacattaaaaaatgcataaaatcattaaaccaagaaggacacataaaaatattttgacatattttactataaaatattgccaagtagttatatattgcaagtattgcaggcatagacaatgcaactactaaaagctgtcctaatgctatttgtactactattatatcacttctatcatcagcagagttattagattgaaatacaaaaattgatataatagatattacaatcagccctaacgatatctttaaaaataatgatgctactacagctcctgttactaatataccatatgatacataggacattccgtatattaagtagaataatacataacccaatattaaagacaagaccgcagcccaatgattctgccatgctggtaaatatccagtacctaaaaacgtgcttattaacctagtaggtaatattttacctataattttcattaaaatttgcaaccaagaaactaacatacgcctatactaattgaacattacaaaccagtaaaaaataaatcttactctttaacttataaaaagaaaatataaaatataaccaacactatctaaaacatacaaatcatattatgaagaacaaatagttacttgacttgttagcaatttgttactatgcttggtaggttattacttagttacattgttgtttatggctaaaaaaggttctactttacttgtaaaattagcaagcagtgcaaaaactggttttttttatgtaaagaagcgtaatcctaaaaaattaattaataagctctcttttcgaaagtatgatcctatagtaaaaaaacatgtattattcactgaggaaaagctaaggtaggtttgggcacacagcattcttctagagacataatacgagttaattttcttggttttggtatagtgggtttgtcgtctcctatgcttggtggtagtgtttgctcttcacattcaattgacggaagcgaagctgaaggtgtatgttcttcacatgtgtctatatattcgctagcagaatctgaactttccgaggggataatagtacatgcactgctctcttctatctttagaagctttccagattccgataatttaacacgcaacttagcacataaacagcagctgatacaaattatagataatatgaagacagcaatagcaataagacaaatgcttgtatatccatttttaccaattgcattaagtatctcatatataattttctcacattcaattatcgttgctataacaataaacgtaattagtacgaaaactgtcattaatgatacaaacaatttagcatatttactgttttctctatttacacctctttttttaacaatatgacaaacctcttttgtcattaaatttttattcattaatttcatgacatagctactgccatttctggaaactaaactttgtctactatctgcaagtagaagagccactatctctgcactaccagtttttatagcgatatctaatgctgtttccttatttgcattgacgctcattaaattaatgttataacaagacagtatctttttcactaaactaattctacgtgttgccacagcttgatgtaatagattattaccattagaatctatattctcaaaaattttttgcaatccatactcggtatatttaagtttattacgcaaaaccggtaacaatagttcagcacatgctatcttattatcctgaatggcaatatcaaaagctgttttaccttcacagttctcctgtaaaataacatcctgccaacctaaatacaaagctcttgacaataactctacattaccagcaataacacattgatgtaataagttattaccacgatgatctacagtagtaattggagtacatccgtcactatttacaactgataaattgatatcacaacacgataataaacaacttactattcctaatttcccttcttcaattgcaaggtgtataggagcacaactcctaccagtatttgtaagttcatcaatttcaccatcatcattaaacacagttgcttgaagattaacatccataccaagattaatacagagtagtaaattatctatactaccacccagagcagcatgatgcataatggttctacccatattatctctagcatgtatcgcaaatggatcatactgaatcaacaattttaacacatccaatgaatcattactacctgcagccaaatgtaatggtgttaatccagattttgcaggtttcggaataatctttgacctacttcctaacaaaaactttgcacatttttttgcattatatattgctgcaaaatgtagtactgtatagccatatgcattagtagcattaatgttaaatctatgttgacttaacacatccttcaataaatgtacactatctgattgtaccaatatagataaaatactatcatgatcgggaccaaaactcattcctagcatacgtctgtgatggattctcaacgcaccatctccagagtaatcttgatctgctctttttaattcttccaatccaattaagcatataaatttgactatgttttcatatgatcccttacataccctagacaataacttatcgttattgcgtataacacgagtaaaattctttaaattttctactagagatttatttttctcagcatttaaatcaaaaccttctgttttgaaacctagcaaacaattaacacattctaaaaatgcattagaaacaatatcttgttgttgtattactttaagcaatgcactctctgttactttttgtaatacatcatcatgttctttcaatttagtgaaagaatgatatataatattaattgcatgaacatcttcacattctaatgcatattgcagtgatgtcttcttgtaatctactacttgataatttatatttccatcactaaagcatgtgatcgcaaatttacttattctgctttcttgtttaccaaacgtactactaaaaattgacttaagaaatccttctttgtcaatagaatcatcaggaaatactaaacctaaactaccaagatcacatacgtaaagatgcccttctaaaacttctccttctatagcatgacaggaatatattgatttaatattctctacaatactataacatcctactttatcttgatatacaagaaactggcaattttgtttaatttttttcttttttccacactttaagaatgccaaaatctctgaaaaaaaagcagaaaaatttccttcccttgatgcatttgctaataatctgtttatgggaacaaggcgctcaggaggtataccctgagttctcatctgacttaatgctgtaatatcttcctcagataacacaatattgtcattaaaattatttgaatctaactgagttccatataatatcacaccatcattgccttggtgttgcatatcaccattattattaaacatattaactatctttatcacttgtttcgattaaagttctataagttaatactatgaaatatatattaacaattgtgctaaagcacaaatcatcaattttaaataatccaacaaattaatacttacttgtaattttcataaaaaatgtaaaagttattttataaaaaattaaaaaaatatgaaaatatcaatagatttataaaatattaatatagttaatttatttaatattattgacttatatattaggaagtattaatataacaatatattattttttttaataattattaactatataactacacaaatgaagaaacattatgatgaataacacacacaatacaaataacgttgtaaatcaagtgcaagacatagcacaagataaccatatttcagacaataatgccaacgaggctagagaagtactagctgctcatgctgcagaaaataacgctaatgaaattagagaagtattacatgactattctctagatgactacgctatagatgaccacaacataggcggtaatgctgaagcacaagatgactattctttagatgattatgctatagatgactacaatataggcggtaatgctgaagtacaagataaccatatttcagacaataataccaatgaggctagagaagtactacttgctcatgctgcagaaaataacgctaatgaaattagagaagtattatatgactattctctagatgattatgccatagatgaccacaatatagatggtaatgctgaagtacaagataaccatatttcagacaataataccaatgaggctagagaagtactacttgctcatgctgcagaaaataacgctaatgaaattagagaagtattatatgactattctctagatgattatgccatagatgaccacaacataggcggtaatgctgaagcacaagatgactattctttagatgattatgctatagatgactacaatataggcggtaatgctgaagcacaagataactattctttagatgattatgctatagatgactacaacataggcggtaatgctgaagtacaagataaccatatttcagacaataataccaatgagactagagaagcattagctgctcatgctgcagaaaataacgctaatgaaattagagaagtattgtataattattctctagatgactacgctatagatgaccacaacatagacggtaatgctgaagtacaagataaccatatttcagacaataataccaatgagactagagaagcactagctgctcatgctgcagaaaataacgctaatgaaattagagaagtattgtataattattctctagatgactacgctatagatgaccacaacatagacggtaatgctgaagtacaagataaccatatttcagacaataataccaatgaggctagagaggcacaagttaatgaagagttggataacgtaaatacaactgctaatacacaaaatatcaatgaacgattagaacattgtcacatttcgcagacaaatctacacaaacacacttttcaaaaataacattaaaaaatcaatatactaattatacaaacgtatagttagtatattgaaaccttgcaaaatagcagcattaatgtacttaataagtataaaatgactgtcaaaactcgcgatattgctctaagttaatatataaaaattacttcatttaacatagtagtctaaacaagttaatatcacatttgtatgaactaataagtttaatacactcggccattgattttaatcatcttatctgaaataacgtcgccagtattatacaaataaaaattaatcagcagtttcactgcaaaatatacttttacaaggaagtcaatctctataatcttccttaacagcaacttataaataataaatcactgatttatataattacatcaccatcagatcatcaagttatacaagaaattatagaaccccattactcatatgtacaataacctcgcacacatataataacctcatataatagtcaatcaaacactacaaattctgcacatttttcaatataacaaataaaatactcactatatattaaatactattttaaatcttaaaattacatcaatgaaaacaataagaactttttaagatattatacttattcgcactaaaaaataatgtttttaactattttatattgaaatataaataaatatattgaatttatttatatttcatgacaccctgtaaaaattacagcaccaagagttaccatgccatttgaagctattaaatacaataatttagaaacagttttaaaaaaaatattggagataccagaaataccacatcttaaccttctaccatacgaatcaagccaaaataagtcatatcaaactttcatagaagaaaacattgagaagttatcagattacaatcgctacaaaaatgctaccagagaacactatcaaatacaaatcatcaacacagaatgtttagtaaatttattattgctaaattttatcgaagaaaagattcgttgctgtataagaaagcaagaaaagtttcaactgttagtaataggagtaatagaaaccaaatgtttcaaattttataataaccaccttcatgatatattacatctcacaaaactacacttaaaaaacttagtatttttacaacttaacgcagaacctaaatggaaaatcaggacttgccattttacacgctacctaaacgcacaaaataacttaagaatactaattctcaacaacagaactaccaattgcctaaaagttagtaatcaaattaaacatgataaacctacattcaaattcacttccaaccaaatagagtatttatttttagaaaattatccactctccattataggctgcttccctaagcttaaattcttacaaatcataatacaaccatacacaacaacaacatacaaaataaaattgttcaaatattttcaccccaattttaacatgttagaacgtctagtgttagttaacgcaaaaattgaaaataatgaagctatatatcctagtcaaaagtaccacaacgtatcaacaatactctcattaacaaatatcaaagtacaaaaatacataagtaataaaaaacatcacataatgatatatggcaatagaaactcaagttatcaaccaccaaacgacactgcttatcaatttctatataacaataatgacagaactttacacttatctaatgaatttacaaaaatacttacaagaaataacatatataacacatataatataaacatttctattaaaggagagatttctcccaacactctcatggaacataataaaacaggtaacattgctttatcacctgacaaatcattaatacaatatatcaattacatatatgatcccagcactaaaaatctatcaaacgtaactaatataatagacacaccttatattataacaggacacaatattaaccagacagaatttgtcgactcttcatcaataaactttactcctgaattaataaaacatactgttgactgcagatataatcaacatagtactcaaattttagacaatggaaattctactagaactgatgacgatttattcacacaaatcattgatgacacatataatcaaaacagtattgaaagttcaaataatgaaagcaccattagtattgactcaccaatacaagttataaatgacatatatgactttaaaattgatgacgttttactaacacaaatcatagatgacatatatgatcaaaatagtcttcacaatttagataccaaggataataccaaaactgatgatgatttatcaatgcaagttactgatgacatacatgactttaaaactgatgataatctgctaatacaaattattaacgatatatacaaccaacacagtactcaaaattcaattcataatattagcactgatgatgatttactaatgcaactcatcgatgacacacatgctcaaaacagtattgagatcccaaataacgaaagtactaccaaaactaattcattaatagaaatcatagacagtatatataatcaacatagcacttcaaatgcagacaataacaatgatattacagatggtaatgattcactaacccaaatcacagatgacatatatgatcaaaatagtcttcacaatttagataccaaggataataccaaaactgatgatgatttatcaatgcaagttactgatgacatacatgactttaaaactgatgataatctgctaatacaaattattaacgatatatacaaccaacacagtactcaaaattcaattcataatattagcactgatgatgatttattaatgcaaatcatcgatgacacacatgctcaaaacagtattgagatcccaaataacgaaagcactaccaaaactaactcattaatagaaatcatagacagtatatataatcaacatagcactccaaatgcagacaataacaatgatattacagatggtaatgattcactaacccaaatcacagatgacatatacgattttggaactgatgatgatttactaatgcaagttactgatgacatacatgatctacacactactcaaactttaggcaatgataaaaaaattaaaactaataatgatctatttgtaactaacattcaatcttatagaccggcaaaaagtttaaatatacagaacatttaactaagcacaaataaacacaatgtagataatagtaaaaactagaaagtaaataatgtaaaagcaagtatcacatcattaactacaattagtctaagaccattttaatcataatgatacaccaatagataaaattacaagttttcagacgttccattgctcattagggttatgacttttaattacagtcttatattaaaaacataacattcagtacacaaaaaataataacatttcttatgtttagaataaaacagtgatcaaaaaaacttacaaatattctttatttaacatattaagcacttgacaagtgtaacatatatactaagacatgtatcataaaatatcaaattaacagcataataattagaaattaaataagttgattcttgtagtcgtatgttatatattacgtagcgataggtatggtttttgtttcaattaataaaccactacagaaatcttaccctactaagcttttaatgattattgtaaatttaatattgcgtatgttaaggttgtgtttacggcattcgttttttgcaagcttattatttaatgatgtgtataatttcaatttttaatggataaattatggaaagtaatgacgaaaagttagaatctgtcaaagatactgtgactaaaattgtgattgattgtttaaaactaaaagacgaacaaaaagctactctatccggtagcactaatttagcaaaagacttgaatcttgatagccttgatttcgtagatttggtaatgtgcttagaagaccatttctccatagaaatttccgatgaagaagcacaagaacttgaaactatagataaaatagaagagtatatacgtaataagttatcaagtaagaattgattggagtagcttatatggcaaaaaagagagttgttattaccgggctagggttagtcacttctctaggtagcgatttaaaaacagtatgggactctttatctaaaggaatttcaggtataagaaaaattgatagatttgatacatctgaccttgactgtaaagtagctggtcaggtaacaacaaaacctgaatctgaagaatatatttttgatgccggagattatataccagaaaaagatttaaaaaaaatggatacttttattcattttggtatagcatctgctacccaagcaattaatgactctaatttacttgattataaagatcttgactatagtagagtaggagtaatagtgggatcaggaataggtggtctccaatttatcgaaaaaactgttatatgtttgaaagagcgtggtccgaagagaattagtcccttttttattcctgcaagtttaattaatttaacatctggtcacatatccatgaagtatgggttcacaggattaaatgatgcagtagtaaccgcatgttcaacaggagcacaagctataggtaatgcagcaagagtcattcaatctggtgaagcagatgtaataatagctggtggaacagaaagtgcaatctgccgtataggaattgcaggatttgcagctatgaaagcactctcaacaaaatttaatgatactccagagttagcatcacgtccctgggataagcaaagagacggatttgttatgggagaaggttcaggagtagttatattagaagactacgaacatgctaaaaaacgtggagcaagaatatacggggaactgttagggtatggcatgacctcagatgcatatcatatgtcagcacctcatccagaagggaaaggtggaataaaatctattgagctcgcactatctaacgcacaattaaacccagaatctataaattacataaatgcacatggtacttccactcctataggagatagtatagaaatccaagcaataaagaatgtatttaaggaaagcgtatataaagtaccaatatcatcaacaaaatcctccataggccatttacttggagcagcaggaagcgttgaagctatattctgtatacttgctatgaatacaggaattgcccctcctacattaaatttacatgagtcttctgaagatccaaaattaaatcttgttccacttaatgcacaggaacataagatcaattattgtctttctaactcttttgggtttggtggagtaaatgtatctttagtatttggtaaggtgtagagttattttggttacatatcttagtatataatcttcacatattttgttctgtaatactagttaaaacattatcgtctacttttactaatatgataatttatacttaaacattatacattatagttgccttctatccttgtataaacaaaagcacagggattttaatatttctactacacaagtgtattaataaatatctcagattcataaaaaacgtgcagtaggtaacactaatttcaatagagttcttaacaataaatactatttattattactaattatttgattaatataagttaatatcttaacttatattattagatacaaaaaaagttaattatgaaaatcaataaagaattatcccaccaagaactgatatcatgtcttagagtaataagaacaccaaacataggtccatcaacatttcatgcattaattaagctatataaaacttgtcaacatatactggaagttctaccaaacttaataaaaaaatctaaaattaataataaaattcacaacatatgctctattgaagcagcagaactagaaattgaaaatactactaagattggtggaaaaataattactgtatttgatgaagactacccagaaattttacgtaatattcacgattatccaccagttataacagtactaggagactcatcactgttaaaagaaaaaacaataggaatagtaggaagcaggaacccttccatcaatggaaaaaattttgcttataagttatcatacgaattagctaactctggttttgttatagcgtccggattagcaagaggaatagataaatctgcacatagtataatttaccaacaattaccaacaattgctgtcatggccagcggagtcaacatagtatacccgcaggaaaatatacatttatataacaccatagtagataaaggaggattaataatcacggaatttcctttttctacattaccaagggctcaattatttccacaacgtaatcgtataatttctggattatcacttggagtagtaattgtcgaagcatctatacaatcaggatcacttattacagcaaatttcgctttagaacaaaatagagaagtatttgcagttcctgggtcaccacttgaccataggtgtagaggaagtaacagtctaataaaaaacggagcaaaattagtagaatttacacacgatatcacagaaagtttacaatttaacaataataaaccttacatacaacaatcaatattcgataatacaacaaaaagtgataataacctttttgaaatcaataatgcaaaagatactattctgcaatacataacccatagtccaaccgaaattgaagaaatcattgcgtctactaatttgaacatcagtagtatattaatagccttaattgagctagaagcagcacaaaaaatagaaagatttcctaacaataaagtagctttaatgcactactagacttaaaaattaatactttttataaaattatcttttagttaattaagtcacttcaataattagacaagaatagaaagattccataacaataaagtagctttaatgcactactagacttaaaaattaatactttttataaaattatcttttagttaattacgtcattgcaataattaggcaagaatagaaagattccataacaataaagtagctttaatgcactactagacttaaaaattaatattttttataaaattatctttcagttaattacgtcattgcaataattaggcaagaatagaaagattccataataataaagttttttggatatcataatctcttaaaatctaaaaatttttttataaaatacttttttaagcatttcacaataagtaagctactttaatataaatatagagacatacaaaaacacatattaatgtctacgaatatgtattcaccacacaaactttgaaaatcacacttaaaatcaacaaaactacatatactagatgacattaaatatgtagttttatattgtcaacatatccaaattatttcactatcttcttgaaaaaagcctatctatctcaactaaatttagctctacataagttggcctaccatgattacattgtccagaatgtgcagtattttccatattccttaaaatagcattcatttcttcaatctttaattttctaccacttctaatagaactataacatgctatagtcccacatatatccttaatcttatcatctaagaataaagtatcacctacttccataatactatcaactatattaataataagcgatttaacatcaaaacttccaaaaagtgctggaacttcccttactattaccgataaattaccaagtggttcaatgagtaatccaagttttaataacttttccttatattcaacaagtaactccaaatcaagatggttattcatttcaataatctcaggtatcaatagtatctgacgctttatcccctcttttgccataacttgtttcatatattcataagttaatctctcatgagctgcatgctgatcaataataacaatagaatcctgtgtttgagagatgatatatctactgtgtatttgacataaagcatagcctaatggataagtatcaattaatgaatcacttggtacttttttactagtattaaacttaccactatctatactaggtgactcctgtagaagattattagctaaattaacaaaattttttttctctcctaatatatcaaaattactaacctctattttagaatctcccttattaatatgctctctagaattttcataaactctctcttcttttaatttattcgttatcatttttgaatctgtacaaaaggagacattagtatctaacaaagattggtcatctgtttctacatttttagaactatatttttgcacgtcattgttaagtaatggttttctattttgaaaacatttaaaaaactcggaagaaacgctattacctatgtttcttgaatttaccatactagcatgtacaaaatgatcattttcaaattcacttatagactttaatttagtatttaggttgatcgataacacttctttaattgcattaactacagttctatatactaactttttatcttgaaatcttacctcagatttattcggatgaacattagcgtcaacttgatcacatggaatatcaagatataatacaacaactggatatttatccttttctataaaatcactataagcatatctaactgcacctatcagtaaattatcataaacaggtcgactattaacaaaagtatatataagacttgacttaccacgacttaatgtaggagatccaatataacctgataattgaatctgctcttcttttacattcactggtaaagaatttttacaaaattccattcccaaagtttttatttcagataatctatcaatatttgattgttgtgttaaatatttaaatacctgtttattatcaacaaataatgaaaacattacattatgatttaccatagctagtttgttcatcatatcaataatagattgaacctctgctttttctgtcctaagaaactttaacctattaggtgtagcaaaaaacaaatctctcacttcaatataagtaccacaagaaagtgcatctggtgtcaattcttgtgttttttctccaccttcaaataccattaaccatgcagtatcagaatctctatattttgaaaccatttttacttttccaacagctgcaatagaagttaatccttctcctcgaaaccccaaggatctaacttttgttaaatcaccatcaggaagcttagacgttgcatgacgagcaaatgcaatttccatatcttctttttttattccaataccattatcactaacaattattaaattacgtcctccacgttctattgtaatacttatggcagtagctttagcatctattgaattttcaactaattctttaaccacactagctggacattctattacttcccctgcagcaattctattaattgttctaggatctaatagtataattgacatatgctaacactgataattgaaacaacatttatagacatacagaaataacaactatttcttagtagtacaaccactaaacatccagtataaattaccttaagtaatttactactataatttaataatgttttcaaaacatctataaacctaattttatcaattcaagctacttactacaattaaaaatagacttataaaacacatgcatactaataaataattcacccttttataaatagaaccacaaactattagaagcctttttcttcaagggtattagtatacgggaacattaaggttactatagtacctaaattaggttcactctttattttaaataccccatccatcagttcaactaatttcttacttaaaggtaaacctaaccctgtaccttcatatttacgagcatgtctactatctacctgcccaaaaacagacataaccttatacaaatcttgctgtgctatacctataccattatcaataacttcaataacaatcatgctattttcgagatcatattctaccactaattttacacatccattttcaggagtaaattttattgaattggataataagttgatgataacttgtttcattcttttaggatctgcaaccattataatttgattagatggtaatacttgttcaagtcttacttttgcttcctcagctcttggaagtatcatattaaagcaggaagaaataacttttcctaaatcaaattttacaaattctacaactaatttatcagcctcagccttagagaaatctaaaatatcattaattaagcttaatagatggacaccagcattgtgaatatcatttatatactccttataatgaacattctctatagcccccatggactcagccttcatcatttccgaaaacccaataatagagttcaatggagtacgtaactcatgactaacatttgcaagaaattgtgatttacttacattctcttgttctgctacttcctttgcttcttttaattttagatttgcgttatactgcttacttagcatttttgcatttttataatatatacaccaagttacaacaataaatataataatgactaatatgactatcattaaaaacacagtatagaaatttacaataaaactggataaattttctgaatttttaattatctttaaaaacattaaaggagaactatcttgaccatctaatgaaaatataggaaatatagacacagtagttgctccattacttactctatggtctacatattttcctcttaataatgaattcatatcttcagaacgtaacagcaggtcctgatctgcaatatcttcactacttctattagaaaatattacatttccatctacattatataaaataacatgaaaatctttaaccccacctaaagctttgagaaattcagcacgtaactttatcaacaaattcatatagtacgtatttgttgatacatgacttggagcctttgctaataattgagcatatttattgatcacagaattaacaagtattgctttaatattgacattgatttcttttgaaacttcatacagataatcatccctcaaatatatatgcgtataaccaactgcaaagcacaaagtcattactaaaaacattaacaataaaattcgaaaatatttcatatatatacccaatcacccatagcatgataatatgtatatggtgctatttataaactttttcttagttgacatataacaatatcgtgttacagttacacactattatattctatttacttagttctttaattttgaggaaatgttaaatgaatagttcgccaattttacctgtttatgcaccatctaaggttactttctcacatgggaaaggagtctatttatacgactataataataaaaaatatgtagattttcatgcaggcattgcaactagttcgttaggacacgctcatccagcattagtaaatgcattaaaaacacaaggtgaaaagttatggcacatatcaaatgtacatacaatacctgaagctatcaagttagcacaaaaattagtagatattagcttcgctgataaagtgttttttaataattcaggtgcagaatctgtagaatgttgcttaaagatagcaaggtcataccaatgtggtaaaggtaatactcaacgttatagattcattacaatgaagcagtcttatcatggaagaacatgtgctgcatgttcagcaaatgatccaagtaaattctctccatttcttaaaccatacgttgaatggtttgactgtgtaaatcctgatatcacatccataaaaaatgcaattaatgaaactataggtgctatactattagaacctatacaaggagaaggaggaatcaacgtacttgatgattctttcttgaaagaattacgtacaatttgtgatcaaaacgatatactgctaattttcgattgtgtacaatgtggaagtggaagaacaggaaaattctttgctcatgagcatactggagtaactcctgacatatgttgtcttgcaaaaggattaggtggtggtttccctatatcagcaactttagcaaccaataatgcttctcagtttatgggtgttggcatgcatggttctacttttggaggaaatcctttagcaactactattggaatgactgtagttgaagaaattttaaaagatgggtttttagacaatgtaactaaaaatggccattatctgtacaaaaggttggaagatttagctaaaaaatttccagtaattgaagaagtaaaaggtaaagggctcatgataggactaaaaatcaatactaatattaataatagagaattaatgcatgatttaataagttgtgggttactaaccaacactgcaagcaataatactttaaggatagtacctcctttaatcataactcaacaagaaattgatgaaggtcttgctatactagaaagttatctgcaaagcaaatatcatcagtaaataacaagctttactaatatcaaatatataaggtttacttacaggtattattgcattattttatcaatattcagtagtatcggctacataatataaagctacattactaatagtaatttaatatataggtattgttttagtacagatagtcttacagataaggtttttatatatagtcaatccataaaatttgttatctgttaacacaagtggttaaagctatactgtttaagtttgctatcattgagttttcattatttgctatagtagtagatggttttgtagtctattatattacaagaatgcaaaacagtaattattatacgataatatatagatattgttttagtacagatagtcttacagataaggtttttatatatagtcaatccataaaatttgttatttgttaacacaagtggttaaagctatactgtttaagtttactatcattgagtttccattatttgctatagtagtagatagttttgtagtctattatattacaagaatgcaaaacagtaattattatacgataatatatagatattgttttagtacaggtagtcttacagataaggttttttatacatagtcaatccataaatttgttatctgttagcacaagtgttaaagctatagtattaagtttgctatcaattggatttccattatttactatagtagtagatagttttgtagcctattacaagaatacaaaacaatagttattatacgataatttatcaactaataagtttatagtctaccatttgagtaacatagattttatagttatattataaatttgcacaatatctctaataatcatttcacaagaaatcagtaaagtggattactgttgttagaaaaccactcagaaagaaaatactgttactaaaaatcaacttgatgtttcataatttatatggtactattaaagcacacttttgtgttgtacaccactcagtggctatttcatctactttttaagttaacatggtacagggctatgatagtaggacaaaacaatcaagggggttcttgcgcaggatcagatgaatatcaaccactaaacacagatccacttccaaatgacgatacatcaacagtagaatataatgagttttcccctctattaaggtcagaagaagatgaaacaccagataaggcaaatgatgaaatactgaataagatagattttgatagatattttgtaattttttctttcattgggttattagcagaagcagcgtcttctatattcaatttagtatcaacccaagtttttattcctactagcactaaacatgcagtagctactgctttttatgctctctgtatactaattgcaatttccatgattgtaagttcaatacttgcaataaagaaatcactcaaccaaaaaaagcatcttgacgatatgccaacagatgcatcaaatgaagaatgtgtagaagagaacgccaaatataaaaaattaaaaaaaatacaggctcatgctcaagtttctgaaaatgctcttactatcatttcacaggtgatgtggcttattgtttatattgcatcactagtaatgatatctatgggtgacaaccaaatacttgaaaacatgagcctgtttttatcgattactgcatctcttttaggtattatatcttgtgttataaggttaatagatgcaaatatatcacgtaagacatctggttctgaggaagaaaaaaaacaacaccttagtttcacaattttttgcggtatcatcttagcttttgagataattcattgtgcatgccatatatcagaagcaatatctcttggtggaaaaatgcacaatctttatgactttcagaatattcctatactctgtttcgaactgataacagtagctatgtttattgcatcattcttcatagaacagtgcattaaaagtaaaggaggaaagcaccagaccaatgatgatggtgttgccgctgccgcttgttgcggtgataatctccatcctagtagcttattagctgatgatagtggtggtaatattgccagacttatagtagcacaagaactatcagcttaacgttcatctataatatgtggaacaataacgctaatttcatagcagtattaacatagtatagaaaatgtataaccgtacaaccaacttacaacttttaaacgctgatgtaatttttaataatctgatgttgccgcttgttgcagtaataataatcctcctagcagcgcattagctgatgatagtggtgatagtattgccagacttatagttaccacacagcacaaggacaatcagtttaacgtcatctatgatatgtggaacaataacgctaattccatagcagcattaacatagtatataaaatgtataactgtacaactaacttacaacttttaaatgctgatgtaattttttaataatctaaggtagtaataatcatcattgtttacatattcgatactattcaagcaatatttctcgctttccagcacttgcaactccaataacaccatctctttccatacgctctactaaatttgcagctctattatatcctattcttaattgtctctggatatagctaatagaagttcttcgatcccttattactatcgacactgcttgtttatacaattcatcatcccgttcaggaatattatcatctatacaataatcataatcttgttggatccgtgtaataccttctatataatctggagttccttgagacctcaaatattcaactatattctgtatttcatcatcgctaacaaaagctccatgcacacgtattattctaccaccagataccatatacagcatgtcacccataccaagtaactgctctgctccttgttcaccaaggatagttctactatctatcttcgatgttacggcaaagctaattcttgttgggaaatttgcttttactacccctgtgattatatcaacagaaggacgctgagttgccataattatatgaattccagcagcccttgccatctgagataatctttgtatcgaagattcaatttctttcccagctacaagcattaaatctgccatttcatctactatcactacaatgtaaggaaaaacactaggctctattgcaattctttcgaaaattgcctcccctgtctctttatcaaaccctgtctgtaatactttttctagagttctattctcatcaattgcttctttaattttatcattataactaacaatattacgtactccaatatcagacattaaccggtaacgattttccatttcacttactacccactttaaagcagcaatagcctttttggattcagtcactactggagttaacaaatgtggaatagaattatagactgacaattctagtactttaggatcaatcataatcattttgcattgatctggagttaaactgtagatcagagataaaatcatagtattaattgctacagattttccagaccctgtagtaccagcaataagaagatgcggcatttttactaaatcagcaataactacttccccatctataccctttcctaaagctatgggtaatttaagcctagaatccctatactgttcactttcaaataaatcacgtaacatcactatttccctatagtgatttggtagttctatacccataacatttcttccaggaataactgatatacgtgttgacaaagcactcattgaacgagcaatatcatcagacaatcctataacccttgatgatttagtaccagcagatggttcaaactcatataatgttactactggaccatacctaatattaactatgtttccatgtatagaaaaatccttaagtactttattaagcaaattgacaacattatcatctggatgaaactctcttttatctactggattaggttttgataaataatcaacactaggtaggacaaattctttatacttttttttttcttgaactacttgaggagttgcctgaggtctcttataaactactatctctttttcattactgtcatcaatataatcgtctttatcatcatatttatcatgacattcttcatcgtaattactttcctcatcttcttcttcacattcatcatcatcttcttcaacttgaaattctaacccttcttcttcatctggaaaatctaattcttctgctaattcctctccttccacctcctcttccataaactcttctattgattcttcctcttctatttcttcttctattaactctttcgttaattcgtcttcctctatttcctcttcttcctctgtaaattctctctcatccaatgaatcttctatattataatactcttgagcttgtcctacattttgagagatttcttctcttataacagtatcactaatattgttagatttatgaattatcctactaaacatttttaataagatatcataaagatatacaatttttttccaaccaataattccagcagtacccaacaatactatagcaagcaatacaataattggacagctttgaaaatagatacctagaacaccaccataatagtatttatggatgacctttagagaaacattcgataccaatccacttattccaaccataatcatcaaactgctaccaaggtacaggtaaatattcctattgacacgacatagtatattaacaacgcaaaagaccattaaaggaattgctataaggctagatataccaaatatttgtacaaaaatatcagctagatgcgacccaacaacgccacctaaatttctcacaggagagtcagtcgccagattgaaagataaatcattttcatgataagtaagaattgacaaagaaacaaatgctaccacaaaagatagtaaaaatatcttaaaggaaacaaaagttttattaaggacagattttatactcacaactatcttacccaaaatagtaacgcaaagcatatcttataaaattaataaatatcaacaatacaagtggtgaaagatcaaaattataggaaatagtaaaaggcagaatcttcctgataaaattcaaggcaggagacatcaatttagataacaataaaaaaacattattaacaatctcattatacctatttacaatattcaatactattaaccagcttaatattatccatagcatcaaagagaaattataaatacttaacaatgtatcaagtaaatacaccaaaggatgcataaagtaatagctctctaattaacataaatattaaatgtttagtgtatagtacactaaaatcatagtcaatcacaaagagaaaaattcaacttgaaaaactcaagagtattatttatgatgtaaagtttactttaatgtttgatcctcaatgggtttattagtaacttcagtatttagtatacttatactactaattttatctgcatttttttctgctgcagaaacaagtataacttcaattagtagttcacttatccataaattaatgctacagggtaataaaagagcccaaatcattaacacactcagtcaaaagaaaaagcttgttataaatactgtattaataggcaatactattataaacatcactgcttcttctattgcaacagcaatttctattgaaattttaggaccacaggggatattattttcaaccgtcattatgacattgtttatactgatattttctgaagcattaccaaaaagctatgcaatactcaatccagaaaaaattgctttaatgatatcgtgtcccttatcatgttgcgtactcattttatcccccataacactatcaatacaatatatgatagattgtattttaaaaattctagacatgcataaagataaagaaatcatttcagcagcagaagctatgagaaatttaatctcactacatgatagtaaaggaaccatgctaaaacaagatttagacatgttgagtagcatattagatttagcagaaacagaaatttcacaagtaatgacccacaggaaaaacatattagcttttaatatagatacaaatataaatgatctaataaaaaaaatattagcaagctctcatagtagaataccattatggaaaaatcaagaagatcaaatcgtaggagtagtacatgttaaagatgtaataacgctaatacgggaaaaaggcaaaaatattactcaagaagatcttcataaagtaatgacaaaaccatggtttgttccagatacaactctgttgagtgttcagcttcataacttcttaaaaaatagaagacatcttgctttagtaatagatgagtacggagcattacaaggaatagtaacattagaagatgttattgaagaaatagttggagatattacagatgaacatgatattacaacagaagctccaataaaacaaatttgcgaaaatatatatcatattaatggttctacttccattagagatattaataggcagttacgttggaacttacctgatgaagaagcatcaacattggcaggagcaattgtgtatgaagttgaacgtatacctgaagaaggcgaggaatttttactatacggattgtcatttaaaatattaaagaaaagtggtcataccatttctagtattcaagttgatacatctccaaaagatacatctactataaaacacaagacagaacaacaaacttaaccgagtacacgttcaataataagaccgttataaccaaattacttataactgcgagctagatttggcatttttgtataaactcatgtaccactttatcaggatattcactatttaacacagcagatataacagctatgccgtcaacaccagttccaattactgaatccacatttgacaaattaatgccaccaatagccacaattttataaggtaaattcttaacccaataattaagtaaatctgtaccctgtggcataaaattcatgttttttaatgtagtaggaaaaatagggccaaaagcaatatatgaaggacgtatatatttcgctattgctaattcatgataacaatgggtactaatacctagtctcaatcctgcattatatatttcattaaagtttgcactcctcaagtcctcctgtcctaaatgcactccataagctttatactttactgcaaactgccaataatcattcacaaacaattttacaccattttgatttgcaatatgtacaccttcctttattttatactctacttcttctattggttcatttttaattctcagctgtactactttaacccctaaattaattacatacttcaaccaaaatagatctggcactatttggtaaaaacctacaggatcaagcataggatgaaaatttttatcaaaataataatctttattaagcgtaataatagggaaatacctttcatctaaaaaactagcatcttcaacagattgattagcagaagctcttgctataattaaagcatccttttgcaagtcagcagcatttaaacacttacttactaacacagatgctttatatgcagacaagaaattttctttaccattacatgacactccgttatataaaaaccataagccttccataccattaaagtaatagtcccaacatctgccatatttctgacttgcaacattaataacatatatgctctttttttttatagagtatagagagttgacacttctaacaatatcatcaagatcttctaattgagtagtacaacagtattgtattaaatctcttttatctacaatgcagacttcactaaaatcattttcagacataaaattcaaaagctataatatcaaatccacattaggatataatgaaaaattacataaaatcactaaaaacacaatatacgacataacatattttaaagaattactgaattcataacttgctaaaacgcatattttaaccataacaataaattagataaacttgattatatccaaaatagagaatcactacacaataaatacatattagcttattgttacacattctatccctactaaaatcaacattattgtactaaaaacatatatctcactacaaaatcactaaaacacaacttgcattaatactccataagttaaattagatattccacaggcagataacaaacaatatacctctattattaaggttgcattttattaaaatactgaataattgttgctgatatttcttcaacaaacttttgtgtaacatctataataggccagccatttcgtgaacacatatcttttttgttctttaatttcaccaatacatgctcgtaatcaatatactgaataagttaaattagatattccacaggcagatcatgaacaatgtacctctattattaaggttgcattttattaaaatactgaataattgttgctgatatttcttcaacaaacttttgtgtaacatctataataggccagccattttgaacacatatcctttttgtttctttaattccatcaatacatgctcgtaatcaacacactgaataagttaaattagatattccacaggcagatcatgaacaatgtacctctattattaatgttgcatcttattaaaatactgaataattgtcgctgctatttcttcaacagacttttgtgtaacatctataataggccagccattttgaacacatatcctttttgtttctttaatttccatcaatacatgctcgtaatcaacatactgataattattttgattcttcatagaaactaacctagtcctccttatctctattaatcggtcaatatcaatagttaaaccaacaataagcttatttttcatatttgataagtccacagataaattaatagagtgtactaatggtatatttactaccctatatccacgataagctaagtatatactggtaggagattttgaagtcctagaaacacctaaaataattatatcagcttggtctatatcccaaagattttgcccatcatcatgtgcaatggtataattaattgcatctatacgtgtaaaatactcatcatctaatccaatgttagtactaatatatggatctttcttaatatgcaaataacaagaaatttccctaataacatgtgacaatacaggaatacatggtatttcttgtgcaccagctttctgctttaaatatcttcttaattcatcatcaaacatcgtatacataataaaattatatttatccttttcaattaatgacattattttatctatctgctcattattattaataaacgaccagacaaattcattaacctctacagatctaaaatgctctagtgcagacctggctactgatgcaacagtctcgcatgtagaatcagaaattaagtgcagatttaaagtaacagaagtgctcatataaaatagattactaatacaatataaaaattgacaaccactcccaaaaaaatttattcttatttagtatacatacataaaaggaataaaagtaagtaattttaaatataaatttcttataaaaatcctggttcataactcacataatacattttaatattaaaatcattattgatatagactagtttcaatacccaaaattaacagaacatagccacacacataaaaatttaatactaacatttacattaacaacaactatataatttactattaaccttataagaagaactataaataaattttagtgatatctaagaactcagacaaatatcaatcaactgcattttctttctaaacgaacctacacaacttactatcttatatttagtcacctatctaactatacatatctttcaatacggaacataggaaagcaacatctaactatagcaaacttacttaaacaaaaacttatatttttacattttccttacagttaaaacataatacatgtcctcgagttatcgatttcatttcttctggagtcacacaaacatcacatgatacacatttcacatgagcaggaactaatttattatcaactgcaattctatcatcaaaagtaaaacaatcaccttcccaaagactatttttattttgagtactcttaaaatactctaatattcctccttttaaatgatataccttactgaaacctaaatctttcataaaagcagtagatttttcacatctaataccacctgtacaatacatagctataatagggtcttgatctactttattagatgcccaagaaatagcccattctggaaaatcacggaaacactttgtctgaggatttattgcattcttaaactttccaaaatttatctcataagtatttctagtatctatagtataaacatcagatctagaaattaaatcatcccaatcctgcggacttacatattccccacaaacagaattatcaaaatcttcaatacctagacatactaactcctttcttaacttgactttcattttggagaaaggattatgcatagcaaaacttttatgatatcgaatatcttttaacctatcatctagattcaaaaaagagaaaaactcatctaaagagctctgtttatcagctgctattgtagcattaattccctgttcagctaaaattatagtaccctttatactatgttgtacacaaaactcctttaatacaggttgaatatcataatagttagacaaatgtacaaaacgataaaaagttgaaactacgtaccccatattatgtttctctttaatcctccaacacactctaatatattttataaaggcaatactgtcaattaagcttaacaatcaaccatacatgtttactattatacattaaaaaaaataccacatggtatttgcatattctattaatagagaactattagtatataacataagtacctataatatatcttcgacaagtaaaatctctaagtctctattttatattaactaggatagatgtgttagtacagtatatcttactgcacaaatgcatttaataaatattattaatacatagctctaatgatttaacaactatttaattaatatttttaagaagaaaacacataaaacattatatttaacataccgtatcatatattaatacatacaaacccatatcaatagccaatcaagtaatagaactatttgaaatactataaccatgtataaaatcattaatgctacatggatttttcccttccaattgcactataagtggaattaaaacaccgtttttacatttaatatgcatatgagaattaatcactgtcccaggctttaaattttgcaaatcactatcaggacaataattagcctttaatattctgagtcttttatcattgaaaaataaaaaagctttaggatacaaagctctaatttttctacatataacctgagcttcctcattacagtctatatgaaaatctattattttattcgtatatgtagcatcattagcattttgtttaataggaaccaaatgatcaatattattaagcacttcaattaacattgaacttcctaagttagatagtttttggcttaaagtatcaatgttatcttgttcatctataggaatatccctttgcagcagaatatctccttcatcccatagctcattcatttgcataatggtaactccagtttgttcgtcacctgacagaattgcataatgtataggtgctgctccacgccatcttggcaacaaggatggatgtatatttatgcatccgtacttaggtatcgataacacagcctctggaataattaacccatatgcaactactacaatgacatctggatttaatgcaaaaattttttcttgctcataatcatgctttaaagattttggagtattgacctctatattattttgctctgcaataatatgtataggtgttttagtaagcacctttcctctccttccagcaggtttaggaagccttgtatacacagcaataacttcgtgatctttttcttctagaagagcacatagagccggtacagaaaattcgggagaacccataaatattattttcatagcaaaatacattcagttatatacagcctatttatattaaatatataaataaggcaagcttgtcccacctaatctttcacttgatacaaaaaaaaattatatacacaattgtaccaatcttcccactcataaaactacacatgtaacattaagagaaccataaagataaatttatactgtaactgctgttagatatacccaaatatacaatttgtaagaaatgacactaattatcaacatctcactattgaaggataatacagtacatatttagaatatttttaaaagaaatttacaagtagggctggtaggacttgaacctacggccatatcgttatgagcgatccgctccaaccaactgagctacagccccataattattaaatacagacaatgtatcttgtatcatatacaacagtaatttacaataaaaaattaacgctgtaacactttaaaactattactaaaaatattattaagcaatcctaacatacttaactgttataccatcaagaataaaacaatttaaatataccttatcagactatacactatttatacctacacaaacatagtaaactaagtaaatttactaattgtagttttataatatatccacaacactttccacattaaatacttataaacttaacttacaaagccacctactattataaacagcaattcaagttttaatcagatttcaatattctcaattataatagctatttctatactaaacataattatagtttgttgaacgaaaaattactatgtcgaaactatatggatttatattataccaattactttaatttataaaactatccaatactgcacaaacaatagcccacaaacctactaacagcacttgttaaaacgcatattttaactataacaataaattagataaataggtcattacacttataatagccattttctatactaaacaataattataatttgttgaacgaaaaaccactatgttgggccaatatggatttatattacaccaattactttaacttacaaaattatccaatactgcactaaacaacaacacacaaacctattaatagcaggtcattacattgaatatttcacatcgtatagaccacaaaaatatatgttgttgcctcaaattctcaactctatcattgtatgatatcactacttatcatttaacttataagttacttattacaatactaaaacgacaatcaaaatcaatattcataagcaaaatatacatgcactctaatgttgcactgcatctaaatcatcaatttcaaccatatcctgcgttacaatgtgatcttgctttacaatatcaacaatctgccgcgttaaggctgcactaattacttcatcaacattagatacaaaaactagttctaatccttccttaatattatctggaatctctacaatatctttttcatttctagatggtaatataacagttttgataccacttcttaatgcagctaataacttttcacgtaaaccaccaataggaagaactcttccccttaaagttacttcaccagtcatagcaacagtattctttactggaatattagtcatcaatgatacaatagaagtacacatagctatccctgctgatggaccatctttaggaacagcaccctcaggaacatgaacatgtatatcattttctaaaaacttcttaggatttattccaaaatttaagcatctagaacgtacataactatatgcagctttgacagattcctgcattatttcacctaacttaccagtatattttacttcacctttaccagacattaacaccgattctattgttaatatatcccctcctgaatcagtataggctaaccctgtaaccatacctactagatcttcttcttctattacaccgaaagaaaattttcgcacacctgcatacttttcgatattatccatatctacacagatactttttacttccttattaactaatatttcctttactgctttcctcataaggctagcaatctctctcttaaaacttcgtacaccactttctctagtatacatccttataagatgatatattgcattatcagaaatgctccattctttttcctgtaacccatgatctttatataactttggtattagatgcgttttagcaatttctaacttctcattctccgtatatccagatatattgattatctccatacggtcaattaacggcttacttaagtttaaagtatttgctgtcgcaataaacataacattcgaaagatcaaactctacctctatgtagtgatcaacaaaatgcttattatgctcaggatctaatacctcaagcaatgcagctgtaggatctcctcggaaatcagaacctattttatctatttcatctaaaaggaataagggattacatgtttttgctttcttcatttctttaataatcttacctggcatcgcccctacgtaagttctacgatgtccccttatttctgattcatcatgtattccccctaaagacatatgtataaaatttctacccgttgcctcagcaattgacctagcaagcgatgttttacccacaccaggaggtccaactaaacataatatagggcctttaggctttttaagacgctttaaaacagctaaaaattccaaaattctttcttttattttatccattccataatgattattatctaaaatttttatggaattactcatgttaatttttgaatttgaatatttaccccatggcaaatcaagaacccaatgaagatagctagatattatattagcttcaggagacataaaattcatctttttatatctctttaaatcggtcataagacgttctttagcttcatcagatagtggtgtagaatttattctcttctcaaattcgctagcagagtctatgtctacgctagaactatcactttcctctagttctttttgtatagcttttaactgctcatttaaataatacactttttgagtcgtttcaaactgagatttaacacggttacggattttcttttgaacatttaatacactaatttctagctttaagaagtcatatattttctctaatcttttagtcacattgaaagtttcaagaactatctgtttatctgaaatctttatacttagatgtgaagctataatatctgctaagtgacttaattctttcatatcataaattgatgctgcagcttctgcttgtatttttttgctcaatttattccaattatcaaattcacttaatactgatctttttaatgcctcaagtttatcatcaattactaaatctgtatcctcacgtacaacagatacatatgctttaaaaaacagattatcttcaataatttctagcgctttagctctactttctcctttgattaaaattttgacagcaccatcaggaagccttaacaattgaacaacctctgctactattcctactttatataaatcatcagcagtaggattatcaacagacccatcaatttgagttaataataaaattttacaattattatgctgagcagcatactctaaagcattaatagatctttctcttccaacaaataacggtattactacttgaggaaatactatagtatcacgtagcgtgagtactggtagtaaagttttatttttcatataatacctttaatgttttaaaaataagtgcgagcttaccatcaactcttcaaccatctccttactaattactacttgattcacatcagaacttccagggctttcaaacattaaatcaagtaataatgcttctaaaatagcccttaaacctctagcaccagttttcctgacagcagccttttttgcaattactgataatgcactatcatcaaactgaagattaatattatccatttcaaaaagtttcttgtattgtttaaccaaagaattttttggttcaactaaaatacgacataaagtactctcatcaagctcacctaaagatgtaataacaggaattctaccaacaaactccggaattaaaccaaacttcactaaatcttctggctcagtgtaacaaaaaatatctttattctttgatactttttgtacattcgcttcaaaccccatactactacctctatgacgagattctataattttatctaaaccatcaaacgcaccaccaaatataaataaaatattatcagtatttatttgtataaactcttgatgtggatgcttcctaccaccttgaggtgggacagaagaaactgtgccttcaataactttcaataaagcttgttgaacaccttcgccagatacatcacgagtaatagaagtattttcagactttctagaaattttatctacttcatcaatataaattatgccacgttgtgctgcatcaacattaaaattagctgcctgcaataattttaacaatatattctctacatcctctccaacataccctgcttccgttaaagtagtagcatcagccatcgcaaaaggaacttgtaaaactctagctaaagtacgagctaataatgtttttccagaaccagtaggtccaatcaacaaaacatttgacttagaaatctcaacttcactaataacacttaaattcgataaacgtttataatgattatacacagcaactgataaaactttttttgagtgctcttgccctataacatactcatcaagaactttctttatttcctttggttttaacttaagagtatccgtctttttataagatctactttcttcttgtaatataccactacataaatcaatacactcattacaaataaaaactgatggcccagcaattaacttacgtacttcactatgaatctttccgcagaaagaacagctacaagaatttttttcattatctgccatatctctccaattttaattactctaccccaatatcgagacgcttctcaataactttatcaataataccaaaatctttagctttctcagctctcataaaattatcgcgttccatatttgcaacaacttctgataaatctcttcctgtatgctttacataaatatcattaagcctacccttaatatccaagatctctttagcatgtatttctatatcagttgcttgtccttggaaaccacctgaaggttgatggatcatgatcctagaattaggaagtgcataacgcattcctggttctccagcagccaataacaaagatcccatagaagcagcttgccctaaacataatgtagaaaccttaggttttatatactgcatagtgtcatatattgataacccagctgtaacaacaccacctggagaattaatatacatacatatttctttttctggattttcagattctaaaaatataagctgcgcaactattagacttgccatttgatcttctatcggtccagttatgaagattatcctttcctttaacaatcgtgaatatatatcatatgcacgctcgcctctactagtctgttcaactaccatggggactaaagtcatagccatctccttttctttacaatcactataaatgctgtcttaaactaatccatttaatataattttacaactatatattctcaaacataaggcttatatctttagctgtcataaccttcttgtcctttttggccagccctattatatagttaatgaccttttcttcaagtactttcccactaatataattagcaaaatttttattagattgcagcattttcaacacattaccaatatctactccataatcagcataattgctctgtatgaagctaaaaacatcttcatttttaatagtaatattattatgacgagacatctttatcagtaacataccaagcttaactcgctttattgcttccttctctacatcaatttgtatatcttctccagaatcacgtatttccttgtttatttttgcaatttcttgagtaacaacacactctggtacatctataacatagttagcatccatataatcaaataattctttcttcactatagtgaaaaccatttgatcaaattgttgctttattcttttcctagcaaaatcttccatatgacctacatctttaaagccataatcttttgctatagcttcactatctcgcatacctttcataacatatacacttttaacagtaactgacatatctgtagtttttccagcaagatgtaccataccataatcgttagggaaagttagaggaaaagttttagattccccaactttcatacctatcaactgatcttcaaattctcttaaagctacacctttacctaacaccaacacaaagtccttggcagaaccgcctctcaagattttaccttttattttattttgataatcaataactaatttatcactgccttgaattacatattccggatcatccactataacaaaatcaggtctttgtttttttaaattttctataaattcattgacatcacactcttgtatatcaacttctatatcgcttaaaactatattatcaatatccattaatggagcttcaggcataacctcaaaactcagtttatagactaaatcttcttctttatcattatcagagtaatagctaggataagaaacaatatcaatattcgatgatattatctctccaaatttactatttttaacaaaatcagaagacgtactttcaatagtcttcttcactacactagtcatagcttcatttaaatattctttccttactaaatcaattgaagcctttcctactctaaagccaggtacctttacattcatagcaatctctgacaacttagaatctaactggtctaaaaaatactttttatcaacagcaaattcatattcccacttcaatttatcatttgaaacttctctaactacataactattcagcatattacaatacccttactgatatataaagtgcggatagagggacttgaacccccacaagtttccttactaggacctaaacctagcacgtctaccaattccgccatatccgcacaaaaatcatcgctacaatattaacaaactatcaagcaccaaattatagacacttatcagataattctcaagattttataatcaagtagtagactttacaatacgagataattttattataccagccctattataacgatcacttaactacattataaaacattcacaactttcaataagtgatcccggtgtgattcgaacacacgacatactgattaagagtcaatcgctctaccaactgagctacgggatcttataatttaccacccttaagtaattagactaaactttgataacacttttgtcaaattcaaacacgtaaccttttactttattatttgattaacattgtattaacataaaatacctatttttcattaaactaatttaatatttttttcaatacggtaatcttgactattaacactataaattatacaataagtggatgctagattagcataattacggagttttcatgctgcaaggttacatcacatgagattattacaaattctttttcttatgatattaatgtgcactatatctagttgtggtactttttcaaaaagagagcgcagaattaagagcccatgcatcaattcagtagacagtagttcagattgttataagtaccgtgtaaacgatcattggttaaaacatcagtaattagcatattaatacttcttgtataagaagttaggcttattttaatagtttaagtatttttatttttttcatgtagaggtagtatgcaattatatacaatagtagctacatggtttggatgtggaaatataactagagctccaggaactattgctagttttgctacaatgctactttctcctgctattatattaaataatttatttggcatattaattatcgtattaacaggcatcatgggtttatttgcaattccaaaatatttactggaccaccctaatatagttgaccctaaagagattgttatagacgaagtcatcgggcaattaatagcattttctatccctatagtcttcttcagatattatcaatacgtacctcagacatttaacactttgtatttattattttatattaaaatactcattacaagttttatattattcaggatattcgatataacaaaaatatggccaataaatattcttgaaagaatatctggcactaccggcataatactagatgacgtacttgcaggtattatgtcctctatatgcactatatttattattgctaaaataggtacttagagtggaaaatgaacatatttcttccttggtaacaagtaacttaaaagattacatgatacatacaatgcaaacatcaagtctagagattcattactttcaaaacattacgttaaccatcaataacagtaagagttccttacttaactttgcttttcacgatagtacaacaaatgaatgtaatgaagaggctgtaaaagaagttatacaatttttaaaaaagagaaacatagacgcaacatggccagtagactctcacatgaaaaaattaaaaatgactcttgaaaaactaggcttaataagcgtcagtcttcctaaaaaagctcttgcaaacatagaaaattacattatgccgcccacaaaaggcccaaacattacgctagatattgtaaataataaagaaaagttattagaactagatgacattgccttaagagtattttatagtcaaaaaaatgaagtggcaactttcttaagagggttagctaaccatcatgatatcaataattctaaattaaagtttttcttaacaaagtgtgataacattaaagtaggtatatgtggaatgtatgtacaagataaagttgtgggattttatagtgatggtgtacttcccgaatatcgtaataaagggatagcaagccaaatggtattagaaagaataaaaatagcaaaaaaccaatacaattgttcttatgcagtagctcaatgtatgaaaccttctgtaaatctatataaaagattaggattcaaaatgcttggtagtttgtctttatacacatctttggtgtaggaatttactagaattataacagattaagaagatacattattatgtttacttacattaccatttttttgttaatatttgttttaggtttattaatcaatgcttattatcgtgctaacatcaacatttgtgctctaaaacataataataatcttattaacagtttattatcaactttaggagatgggttctacctttgggatgaaaaacggcgtatagaaaaattttctccgaacctacaaattttacttaacactgtattctattcttttgacgaatttgctgacttttttgaagaatcaaaagaactacaaaaaaagtttactgaagctaaaaaagttaacaaatcttttactatagacttaaaaggacaagatacagaaatttattgttcttgttatgggcaaagtatagtcgacactaatggacaaatcataggagtcttgctgtgggtacaaaatataacaaactataaattatcaataacaagcttagaatatgaaaatacaaaattaaaagagaacctactaaactacactgacatattaaacaacttaccatatccactatggaaaagagggaaagattccaaaattaagactaagaatctattttattctgaacttgtacaacacaacttaaacatagacacagcccacaatacacgacttatcaataaaaagaacaacaaaattagtcaaaaaatacaatacgctatcatcaataatgaaagaaagctatacaacatggtagaaatcccaattaaaaactcaaatgaatttattggatatggagaagatatcacacgacttaattattttgctcaagaactaaaaaattatactaccctacaaaaaaacttattaaacaaccttccaaatgccgtggcaatatacaatagagatggatcaattatattttacaacagaattttcacaaaattttggcagttaaattcttcatggctagatactcatccaaactactcaagtattttgcaaaaaatatacgaagatagtaacctcttagacaaagaaaaatttgacttaataaaccaacaacaatatgaaatatttaaacaaattactgaaccataccacggaactatggtattaaaagacaatactactttaaaaattatagtaatcccaaactttaaacaagaattaacctttatatacaacaaataatattgctttattttgaaaccaacgcttccaatcctttatttattttgacgctcctcataccaagacaactgtatagattcaagaatcttttcgttacacccattatcatcgtcatcaaaacctggtaaccctaaaatcattaaacgcaactctgtaaatctagtattgaatatatcatgttccgggtaatggtcctctaaagatatagcaatactatcaacattattccatttcatataaacactctacctgagattataacaatcattgcattatatactacaaaaatataaagtaaactacactgcaatatactaaaacacaaaatatatttcgataaaggtaaaaatagcaagtaagtaatatttaaaaacatctcgcatgatgaattacactgtatagattcattaattagattattaaacctcacaataataccccacttcagcattacataataacatacaacctcgtgttctaactaaacataacagagcatttaagtaatatttaaggaataacttgcatgatgaattataactatatagattcattaattagattattaaacctcacaataataccccacttcagcattatataataatatacaacttcgtgttctaactaaacataatagagcatttattgtaaaatcactcaaatcaaacgttcatgcttaatctaagaaaaatatcatcatatacatcccaaatacctaaaacaaacatacaaataacaaaacaataaccctataacaaactgacacatcatttcaggtatacaaaataaacaatctaacttttcttcatatgaacactatacataactttagataattataaacacacatctctataaaactatagctactaatatttataggttttcttatcctttaactatatttatcacaatggtttctcaatcagcattattataaaatttactacccatatagtgggctataagtgctcttacaaatacaccaactattgctgttataggaattgacaataatacccctgtaaatccaatttgtgatccacatgttatcattccaataattatccatataggatgtatatctacccgttttcctattaataatggagtaataatattcgactcaactaactgtccaacaatgaacattgtcactaccactccacacatcgtccaatcattaaactgtaacattgttgtaatggaactcaatattgcacatgaaataggtcctatatatggaataaaagtcatgattcccgatacaaaacctataattaaaaaatactttaacttcaccaaactaaaacatataatgtagtatacagccatgataaaacatacacttaattggcctctaatataagctgaaattacttggtctattttttttgtatataatctagcaatactttgatattttacaggaactagtgcatcagcagattcaacaatcgatggccagttacataatatataaaataataatagaggagttattaatattatagaaattgtataactaatgcttatactagaatttattgcactaaacaatataccatctaaattttttagaaaatttccaaaaatacttacaagaggtttaatgttttcgtaatgcaacaaactttttaaagacgcttgcggcaactttattgcatccgatacttcttcataatcaatcatattatatttctgaaggagagaaatgatactgtctttatgaatcaatggcactttttccataagaaactttataagtgataacaactgagaataagcaaggggaataaaactgaccaaaaatgctataattacacacaacgaagatagcaaaattatagcaacagatagttgccttgatagtttaaatctttgtaacttatccaccaatggattaagaagataagccattatcatagcagtacaacacggagcaagtacaggtttaataacaaacatcaccaaaacaattgctagtacaataacactacgtgttacatacctattaattagcttgcaaaattgatcgctcattagtctatgcacatgcatttttaggtattatactattttagtattttttgcatagatatattatccacttactagcctgggttattaaaaaactctaccacatttaacaattattactctaactcttgctcactatacaaatatcgtaataagaaaaaaaaatgctttctgacattactttagagatgatttttgtgcggatacagcaaaattggtagacgtgctaggtttaagtcctagtaaggaaacttctaggggtttaagtccatctatccacactttaagtatcagtaagagtattgtaatatgctgaatagttatatagttaaagaagtttcaaatgataagttgaagtgggaatcagtttagtaaataccaccagatcaaaacccaactcgatgtatgaagaacattagtaaaaatggtgcccacggggagacttgaactcccacgatcttaattgatcaacggattttaagtccgcaacgtctaccgattccgccacgtgggcctacagactacctagagtagaactctattaccaaattaacttccatagttgctggatacggtacttcacaatacttaggtaccctcaaatatcttatagatttttcttgagtatcgacttctaagtagtcaggtaccttttgctcttgagattgcactgcaaaaacaactgcaggtaaattttttgctttttcttttagtgtaactacatcacctactttcacaacatagctagatatatttactgttttaccgttaaccaaaacatgtttatgggatattagctgccttgcagaaaaaatagttggtacaagcccagaattatacaaaacactcgataacctagattccaataatccaacaaaattatcaccagtatcgcctcttttcttataagctttcaagaaaatattacgcatttgcttactatttatagcataataaaacttaaatttcttatgcgctgcaaactgcttaccaaagtcagaaggtttcttataacccataccgccatgctgaccaggaggataattccttgtattaaatggatccttagatctaccccaaagatttacacctaacctacgacttgctctatattttctctgtattaccatatacccttatttataaacaacttaaaacaatacacgagtactaaaaatactcttaatataacatgatgtaaacatatcagtcttgcaaatacaaaactgcatagattttagtatcataactttatcaatacatgtcaacgtatttttacgaattcataactatacatttatgacatagtacttacacaattaatgtatttataatccctctcacaatttataccacttaccagttattcaactaccctatatgttaaatttactagcatggcagcagcaacaatattactattataatgaaaataaattcatacatggtaattgataaatgcaactaacattatttgatcttgaagatagttattcataccattaccacgactacatactgttagagcaaaacagaacaacatacaatatgctaatgaatcaagaatggaactccttcattctatatggaaaatcaggatcaggtaaaacccatcttgcacacatatggcaaaaacttaaaaatgccatttttattgaccaacatctaatcaacactaaaaaagatataggagacacaatatcaaatggtaacgcctttataattgaaaatatagataacatagataatgaactatcaatgttacatcactacaactatataaaagaaaacaaaaaattattactaatgacttcttctatagctccaacattactcaactatcatacaaaagatttaaaatcccgtatattacatactatgagtgccaaattagctaacccagatgaagaattattaaaaattatgcttataaaactatttgctgataaacaaatacacatagaactaaaagttataaactatattctcaataacacagaacgttcttttcaaaatttgagcaatatagtaaaatgcatagacagaaacctaccttactataataatggcgtcactataccatttgtaaaatctataatagaaaaaaatgactaaacatcaatataaaggtcgagtattaactatagccggttctgattcaggaggtggtgctggtatccaagcagatatcaaaactatatcagcattgggatgttatgctgcaagttgtattacatcagtaacagcacagaatacaactcaagtttacagtgtatataatatgccacaacatattatccagcaacaaatagaagttgttttatctgacattaatatagacaccattaaaattggtatgttaccttcctctaaagcaataaaagcagtagcacaatccttgccagatatccctattattgtagatccagtaatggtatcggcatcaaattttagattaatggacagtagtgcaatttctgactttatagaatatataattccaaaaacaacaataattacaccaaatataccagaagcagaagctttagctcaaattgagataaaagatcaaaatgacatgacaaaagcaagtaagataataaaatcacttgggactaaacacgttctgattaaaggaggacacatcaatcaagagattataaataacattttactaacagaagaaaatcaaattataaatttctcacataaaagaatatctaagaaggaattacatggcacaggttgtactctatcgtcagccattgcaagttttatagcacagaagatgtcaatacaagaaagtgtaaatctagcaatccaatatatcctcaataccataaagatagtaccacaaataggaaaaggcaataatcctgtcttccataactacaatacaatcagtagtgacctttaatttaaaaaaatctataacttttatatagagaaaatttcatttttacactgtcagtttatagctcttaatttaacgaaataactcaggtcttatctgtcacatacacactttaagattaataatacatacaaacagtccaaccattaaactatcaagcaaaaaaatatattgaagattcagaagtagaatattttattatgttgttaatattacacacctgtttaaaaatgttttacgtgataatatgttgtaaatacttttaataatcacatatacgcaaatctattaccgttatcaggaaataaataatacccttattctatcattcagttaattttattatgataatatctgttttatacagcctagtagatgttcttttttgtttacttagttctttactaatatcctccacatacacactttaagattaattaatgcatataaacagtctaaccattaaactataaagcaaaaaaatatattaaagattcagaagtagaatattttattatgttgttaatattacacacctgtttaaaaaatgttttacgtgataatattttgttgcaaatacttttaataatcacatatacgcaaatctattagcgttatcagaaaataaataatacccttattctatcattcagttaattttattatgataatatctgattgttatacagtttttgcagatgttcttttttgtttacttaattctttattaatatcctcactcgtaccacatataatttgctcactcagttcaccaccaagtctacttattgcttccaaatctctacgactaattttcttcttctgactctgctgttcttcctgttttggctcttctatacctctctcagaatctactataaaaccatattgtccgcttacatgacttctcaaaaatttttcatctccacctaacctagctttacatagtaaacttgttttaacaaaatttacacctgaatccctgatacctaaacacaataacctagctgaatcactgatagcagacatccccgccattactggtaaacatctcatattacgattatgtataccattcgtgatggcactagggaatcttattataccttcgcacaaactagcagaatgtctgacaaaagatgaacaacatgttaaactattactaacaatagacaagaaaaacataaataatgtagcagcatatggtctatacctacctggtaaaaccccagaacttgtatgtattatttttttatctactctttgagcaatatatgcagacacattatcacaacatcgtgctacacctaacaatattgcaccaaatgttctacctgtacacccaattgctaacccagctaaattaaagggtaacataagcaaagaaagtggtaagttagtctttttattctcatatttacaaacagaaaatgaataaggataaacttcatgttcactactcaacatgacatctctattattacgtttccctacaggatcaacacatttacttccatcaaaagctacaactaatactttattttcctcttctttagattcaaaatcctcataattactaagcccagcagtatttattgcatataacatatgtccttgcacattaaaaattggcattttgtcaggccctgttaacggagtaactggatatctttttcctttatatattaaataatctccttcaatctttaatcctacattatgacatttacttggtatatatttacatgtttgacttctatgtaaagctggtagtagcgctctgcacttaactttttgattaaccccaaacgtaggaaatgctctaagtattggtataacaccaaaaaaaccatatactgtacgtacaccattaaatatcttcaatggagtagatggtatagctctaacaccacccctaatagccctaaaaatattactaaacatatcttatcaacactaatattacaaaaacacctacttaactatattatacaatagtaaaaaaattaatatcaaaaatatttaatataaagaacataaagaagataaaaaacaattgaaatattatataaaaactaataaaaaatatttagcttacaacacacagggaaattatctatcaaaacccttattcatctaaatataaaaaatgaacagaattaatatcctaacagtacactatataaaattataaatgttaaaaacaacacagttaaaatcacaattcctttaataacaagaaatacagatgctcttaacacaacagaatgtatataatcttctaatataacctgtacacctagaaccgcatgataaaatgcagagataaaaaagcataataaaataataagatcagtattacttatatttgaaatagacaaatgaagttctggaaaagatttaagtattatagaaataacaccaagaaccttaaataaaaaccacagagaaagaggaattaaaacaaaagccgtaaccctttgaattaaccaatgataaactgaatgactaaccataattttatatcattaacttaagaaaaaactataaagtataaaagatgagactagacataaaaaaacaactaccactcccgtagttctcaccgcagatttactcaaacccaatcctaaatcccagaaaatatgccttataccattcatataatggtagcacaatacattcaaccaaataaaagttattaactttagagaatataatgaaacataagaattacaaaaaaaactacaaattctatatactacttgaggacataaaaaagaaagaataaaaccccatgatagaaccagcagacctaaaaatagtatcataccagtaaacctatgcataatagaaagcttatatacaactttgtatatttgtaaatgcggtgataaaggcctaacttttgacattatcaaatttcataaaaataaaagaaatttatgcctaattacaggataaagattaactacacccttaaccatttagacaaaacaattagacaaaatagaaataaagacggcgtagcagcttatcaaaacattactaaaaaataacattagataagaaagcctaaaaggaggtaatccagccgcaggttcacctacagctaccttgttacgacttcaccctagtcactaacccaaccttaaatggctgcttccttgcggttagcacaccagcttcgagttaagccaattcccatggcgtgacgggcagtgtgtacaagacccgagaacgtattcaccgtggcatgatgatccacgattactagcgattccgacttcatgctctcgagttgcagagaacaatccgaactgagacaacttttatggattagctaaaccttgcggtctcgcgacctattgtagttgccattgtagcacgtgtgtagcccaccttataagggccgtgctgacttgacatcatccccaccttcctccagtttatcactggcagtttccttagagtgcccagcattacctgttggtaactaaggatgagggttgcgctcgttgcgggacttaacccaacatctcacgacacgagctgacgacagccatgcagcacctgtgtaaggtccagccgaactgactccccctattaggagggatacgaccttcatgtcaaaaagtggtaaggtttttcgcgttgcatcgaattaaaccacatgctccaccgcttgtgcgggtccccgtcaattcctttgagttttagtcttgcgaccgtagtccccaggcggagtgcttaacgcgttagctacaatacaaagataaaatcctcacatttagcactcatcgtttacagcgtggactaccagggtatctaatcctgtttgctccccacgctttcgcacctcagtgtcagtatcgaaccagatagccgctttcgccactggtgttcctcctaatatctacgaatttcacctctacactaggaattccgctatcctctttcgacctctagtctagcagtattaaaagccgctccaaagttaagccttggtatttcacttttaacttactagtccacctacgtgccctttacgcccaataattccgaacaacgcttgccccctccgtattaccgcggctgctggcacagagtttgccgggacttcttctataggtaccgtcattatcttccctattgaaagagttttacaacccgaaggccttcttcactcacgcggcatagctggatcaggctttcgcccattgtccaatattccccactgctgcctcccgtaggagtctggaccgtatctcagttccagtgtggctgatcgtcctctcagaccagctatagatcatagccttggtaagccattaccttaccaactagctaatctaacgtaggctcatctaatagcgataaatctttcccccgcagggattatacagtattacccatcatttctaatggctattccatactactaggtagattcctacgcattactcacccgtctgccactaacaattatttataaccaaaaggttataagcaattgtccgttcgacttgcatgtgttaggcttgccgccagcgttcgttctgagccaggatcaaactctcaagtttgacaaaccataattaattatggcttggactcatgcaaacaaataaataaaatacgtcaatgcatgatataaataaatatagctatatgcaccgccgcctttatttctattctataaacttaaactattcaaacaacttcatcaattatgacacttagccatgggttgaattatcaattaatatatgattaatgtcaatacattttttaacattaattttaaaataaaaaattaggcaattctaattttcgctccatgtttattaaataactcaattattgcaaacaaatcatttgtttttctcgcattttttattttaataaaattattagaaatcatacccatggtcaaaaataacactgtaattttaaaatcgtaacatgcgtctactgtaccacaatcaaaaatattattagaatgaccataaataattaagcgatctgcttctatttctatcattaccccacatttcatcaattgcttaataaccactcttaaccttttatctgtaagtgttctatttaatacaccacttaaaactgttataccttcagcacatgcagctatcatcactataaataaatattcatcaatatcaaaattttcattgaacagccactcaattccttgtagaacactccccttaaccacaagatctacaacttcttctcccactgcattttttctctgatttagaaagaaaagatttccccccattttcactaaaattttataaaaatttttcattttatcattgaacaaaacatccaatatagtgatttctgacccctttaaaatcaatgctacagttataaaagataacatacaaaaaaaatcgttaggaatacatacattcttggagtataactcacgttgaccagatatactgattaccgaatttttatccaccaaacattctatcgcaacattaaaacgttgtaacatatttacaatgctatcttgagcagtagtaccaactatagttgtggtaccatacgtatttaaagcagcaaacattattgccatctttacactatcttccctagtcgtatattttataggtaacatgtctatacagccaactaaagcagcgggtaatttattattatttgaaataaatctcgcacccattaagaataatggcttcattacattgctaatatttaaattaacctctccatgtagaaaagatgtaaaaggacaattagataaacttcctattatcatataaatagatggatcattaaaacataatatatcttttgaacaaaggaaacctcctacacccattccttctacagtacaaatcttactatttttattatatttaattttaataccaagcgaatttaaagatttaatagtaagtgctatatcgctgttaaagacaatatcataaattttagtgacacctattacctgagatgctaagattaatgttgcatgtgaaagcaaactatctttcagcacgctcacatggccagatatacgatatattctctcagatattatcaccataaatattacccctactatcaggatataattatcataaaatttctagatctctatattccaaactatatattaaaaagatataatagcattagagatatcatcaataaattatattaaaagtgtacaacacatcagaaaatctaaaatacattattaaatacaaagttatatcttatacactcacccaatcataaacacgaaaagtactaccagcgatacatctgaatacatataatacatttctaaacattacaattaccaattaatacaacaattatttaggtaaaatattttgtgttatcaaacatttaaaaagaaatacgctatctatttttaaatacaactcaccataaattaaagcaacattaaactaaaatgctattaatctcaatatcctttacccaatttaacttaaaaatttgtgcaaaaattaaaggagtaactaaaaagctatttggcaattgaattgtcacatgatcatttggaagaaccagatcaattaatacaacagtagatcccctattctgcaacaaactagatagctcttttattacaacactattcttagcattaacatgtataaccatagtttttataatagaagaaattttgttttcaaaactatagatatttttaccaagtaatcgtactgaggcactataaaaagtattatccatctcaataattacagatgcaccagtagtaaataagtctttattatcttctattatatttccattataaaaaactatttcatgaatgttaaaaggatcagaaagagttacaactgcaaacttatccttatttgtagaacgcactttaacattagaaattatacctacaatcacattattataagaagatttatcatcgtagtgaataaaacctatattcaatttgtctaaaagatacttatagttttccatgggatgatgattaagataaaaacctatagaggaaaactcattattcagcttttcttctttagtccaatcatcagtttctgataacttataatgatttttatcattaaacaaactaaattggttaaaattagcattatacttattatattcaataatatctaaaaataaaaatactgattcaaaaagctgctttctattgctatgaatactatccagaacccccgctttaataatactttccagtattctcttgtgcacacatttagtacttactctgtcaataaaatcccatatgtctttataagcaacatcgtctactatctcttttgctgaatgctgtcctacattcttaagagctccaagggcatatctaatagacgatgcaccctcaatagtaaacaatactttagaagagttaatatccggaggtaatatttcaataccatgcaactttgcttgatgacacaacatttctaacttatccttatccattatatctaaattcatcgaagcagtaaaaaattccaacgtataattagctttcaaataagctgtctgataactgatcaaagcataagctgcagcatgtgatttattaaacccatatcccgcaaattttgctactaaatcaaaaatatagcttgccttctcttcctctattccattgctaacagcaccatttataaaagttctgcgttgattatccatctcctccttaatcttttttcccatagcacgccttaacaaatctgcttcacctaaactatatccagccataatcttggcaatttccattacttgctcttgataaattataaccccaaaagtttctctaaggacatcttctaaaattggatgtatataatctggtttttcaaacccatgcttgcgtgctatatatatagaaatgttatccataggacctggcctatacagagaaatcaatgctataatatcatttatattatctggcttcagcttactaattacttccctcatacccgaactttcaagctggaatacaccaacagaatcacctgcagacaacatttcatatgtttttctatcatttaaaggaatacgtgatatatcaacactgtgacctcccctattaactaaatgacaaatttgatttattacagttaaagtccgcaatcccaaaaaatcaaatttcactaatcctgctttctcagtatatttcatattatactgtgtaataggaagagaagacgtgctatcataatataaaggcagtaattcttccaattctctatcacaaattacaatacctgcagcatgtatcgaaacatgtctatacagcccttcaagctttaatgatatttctaataatttagcaactgtttcatcatcatcctgctctttctgcaaatttttatccatctctattgcttcagataaagtaacaggcttaactgggttgtgaggaatcattttacagattctatccacctggaaataaggcatctgcataactctacccacatcacgaagcacagccttagcttgtaattttccaaaagttataatgtgagcaacgtaaccatatttctttcttacatactctataacgtaatctctcttttcctgacaaaaatcaatatcaaaatctggcattgaaatacggtcaggatttaaaaatctttcaaaaattaaaccaaattctatagggtcaagatcagtaatttgcaaagaccaagcaacaagagaaccagctccagatcctctaccaggacctaccattatatcatttcttttactccaacatataaaatccgatactatcaaaaaatacccagcataatccattgagataataatatctaattcataatgcagtctttcatagtacttggaaacttgttctgtagataaacttttactttttaaacgattatccaatccattaatagcttgacttattaattcttgactctcatttttaccacttgaacaaggaaaatgaggtaacataggtttcctggtttctggcataaaagaacaacgctgtgctattaacacagtattagaaactgcttcaggaatatccttaaacaacctatacatctcatcagaagacttaaaataatgctcttctgtgaacatctttcggccttcctgtgcaatataattaccatctgatatacaagataaaacatcatgcgctaaaaaatcatttttcttagcaaacaacacatcattcgtggcaaccaatggcaaatctttctcataagcaaaattaacaagtgttttttctatgattttttcctcttccattccatgacgttgaagttcaacataaagattcccattaaaagcaagtaacaacttatctataatgccatagtcaataacattacctaacaaaagttgggataaaaatccatcatgacctcctgttaaaacaataataccatctttcagatcaataagtttttctaaatctactctattaactttgttggactggctatccttaaatgaattactaacaagattaacgatattattatatcctatttgatcttttactaataataccagttctccaatactatcaccattatagctcatcattatgttacagcctataataggctgtacacctaaactcgatgcataatcagaaaattccaaagatccaaataaattacctgaatctgttaatgctaatgcaggcatattatactgcacacataagttcaccaaagaatctatttttatcattccatgaagtaaggaataatcactatgagacctaagatgaacaaatatttgactcataatcaccaaatttaataagcaacctttatagtgtaaataacacaaacatattttcgcgagagttataaatttatgtaatcaccctcaaaactattgtatgctaagcaatacttaatttacatttaatagacagatatacaataataatttgtaacaacaaattaaaaagcaaaattggtaataaaaatgactataaccaaagtgttacaaaattgtcgaacgcttacttttaataactaggaaatcaacagcttactctacattaacaatacataactccactaaaatcaataaagtagtatcctcaacaccaccgtgtttttcattaagcagtccaaatttaaaacgattaaatatttatcaaaaacaataacttaagttattatacaaatgcaaacaactatgaatttaagaatgaatgttggtgagtttgataaactataggtattttagagctttttattttgtttaaaaacatgggatttgtacaaattatttacactttagagtgctataccaatacacaaattaaatgatcagaaaaaacaatcatgttacctgcattaaacacttgatatatgattaatagtaacatcaataatgcagtatttttacactatatctttcccatcaagcattaacattccaaaatcattaaacatctattaatgaataacttaattcactacaaaaattatatataaattaatatatgcaattactatttttagtaataaacaacaaagacactttaaatactgtattctctttttatacaattacatttcgtttccccctagatcacattttggcgttaaggttgaataaaaagcaaaaaataccaccgttctttattacaaaaacataagttataccattattatacagacattttcatatcctaatcactcaacttcgcacgcttagaaaacgctttataagcttttactgcattcaatataatttcatcagcacgtaaaaaatcataatttttcttataatcaatagttaagtgattattctaaatattaccccaatttgtaacatcaacaatagcactatcataatccctaccaagcacaatgattcccctgagcttgaacataacagctaaaaagtttacaccaacccaatttaagtttttcgggttgtccacaaacaacatggacaaaagcttgttgattaaaccataattctgttagttcatatttaaattgtgcaatatttgcattagtagtaaatacttgatggtgtaaattctcataaagcttatcaatatattccttacattctgtattatctagcataattctaaaaaggcctgctctagaagtattaacccatgtgtaatactcgcattaggagcaaatatttgatgtgcaaattctcataaaacctatcaatatattctctttctgtattatctaacataattctaaaaaggtttactctagaagtattaacccatgtgcaacatttgtgctaggagtaaatatttgatggtgcaaattctcataaacctatcaatatattctgtattatctaacataattctaaaaaggtttgctctagaagtattaacccatgtgcaacatttgtgctaggagtaaatacttgatggtgcaaattctcataaacctatcaatatattctgtattatctaacataattctaaaaaggtttgctctagaagtattaacccatgtgcaacatttgtgctaggagtaaatatttgatggtgcaaattctcataaagcttatcaatatattccttacattctgtattatctagcataattctaaaaaggcctgctctagaagtattaacccatgtgtaatactcgcattaggagcaaatatttgatgtgcaaattctcataaaacctatcaatatattctctttctgtattatctaacataattctaaaaaggtttactctagaagtattaacccatgtgcaacatttgtgctaggagtaaatatttgatggtgcaaattctcataaagcttatcaatatattctgtattatctaacataattctaaaaaggcctgctttaggagtattaacctagttcctacaaacatttaggatttccctatcaacaaattcattaagttctggaggaacaaggaaaattacagttaatattcccaccagcagattcaaaaatagtattcattatgattcattccttaaatatccagaatattttacttgatgtttttttaagctttcatcaggaacactagtgcatgaacaaacaataaaacttactgtaacaaaagaacccaaatatatctgaaaacttccataacactaccttaaacatacataacaaacataagattcagcatgcaaaactatcattgcaagataaccactcatttaaaaaaacatcctatatacttatttcataatattgtataacgtactaaaccttataattaagatataactacaacaatataaaaaacccataatcttacaagtaacagtggtactcaataacccttaatcataaaaccatctactagaaaacaaaactaacacctctgctacatgaacagatatacaccattgtattacataaaactatattagtactattattcattagtaaaacacaatcaaaagttacaaaataaaatggctaaacaatacttaaaattttacctatgttacatacacactaaaaactactttagcaagtaatagctaagcaattaatatctcttcagtaaaaacaaaaccaataataatgcgctactgtacagtttactacataattaacgtacagtagcacaataaattgatactgactatttgatacagctacattctgtttcacctcttctacaatttggagttaaatctgcaaaaaatgtaacaatagaatttttacgagctacaaatacataagtaacatcttcattaccataaagacaatgcctatttctttgttccgctaattgagaattttgagacaaccccttgtaagcacttgtagcatgtaatataatttcattagcatgtaagaaatcataaccctttctaggatcaactactaattgcccattaacatttttaaacataactccaatagtaaatactttatcactaacttcatcagtcaaatcatcatcataatatctaccaacccacttattctcttgagcctgcaagtaacgtccaaagaaatgcataccacctaatctacctagtttaggctgtccacacattatatgagtaaatccatctctattaaaccacaactctgctaactcatttttaaatgtctcaagatccgcatttggagtaaacacttgatgatctaatttttgatataactcatcaacatattctttatatttttcttcatttaatatatttttaaaatcctctactcctggagtactaccccaatcaccacaaacatctaagacagctttatcaaattcattaagcagaggaggactaggcagagtaccacacttagaatattcctctgttttgaaaaaaggatttataccagatgaattattcacacattcatcaggcgtatcaacaacagtcacacatgccattaggctaaatggcaatagaaaaaaacatacatatatatacttatacaatctcataatattattcctcacataacaaaaaaaaaattaacatatctcttattagcataaaaatgccaaatatcatattattcattaaaatttttattaatagtaaatttgctattatttaaaaaaccattaactacgcaaaataaaaatgttacaatacaacaaagttaacattgcaaaaactaatggatatcattcaaaaaatagggaataaaattacatcatcattaaacgtattaaaactcgaaataacagatgagtcccaaaaacataagggtcataatttccattccatctccaatatttcacatctaaaaatacaggtagtatctaatgattttttagaagtaagccaaatcaatagacacaagttactacacaaagttttagagaatgaaataaaattaatacactcaatttcgtttttactttatacagaagtagagtacaacaagctcttataacaagcagataagtattgctatatcagtcatgcatcaataaacaacattgataaaaccaataaatatttacttatttcatcccctatatagtaaataagctattctagtagctagtataatcagaattttaacacttaagttttcgaagtaaaccaaaacaatactaacactaacagattatcatataaagctttaaaagcaattaattgttgtatataaatttataactttaggtaaacttataaaatcatatcatattaattttacaccatgaacacaagcaactatactctttatttatgaacattatccaagatgtattaattattcaaacaaattctattcactataaaaatttcacttaagttttactgtaaacatattcatcattaaccctacagttatggatacagcgatacaacattccatttatccatattattactatccctagtatattgatatctagtgtgaatcctatttaaaccttcctgccaaaattccattaacattggaaccactactattccaacccaataatctggtctaggtattggtttttcatggaattttattgtcatttcttttattaactcaacaaaatcttccctattttctaaaacacttgactgcttagaacaccaagcacctatctgactaccacgaggtctagatgcataatactcatctgcatcattacaaggtagcatttttattctcccttcaattctaacctgctttgaaatacgactccaatcaaaaacaagagcaacagaaggattttctgccatttcttttcctttccgactattcatattggtaaaaaatacaaaaccttgatcactatacttttttaacagaacaacccttgctgaaggtttcaaatctttactacatgtagcaagcaccattgctgtaggatcttttttatcttgtaaagaaactgctaatacctcattataccataaatcaaacaattcaataggatctttcttaatcatactctacctttaacatcaaccaacacagacattttcacactctacttaattatttaatacataataaggttatcttacttatttaatgatctaagatatttattgtactctcattataaattagtagcattgatttttaagaataacacgttagccattttacagcacataataataaaaaatattcacttacacctttcagatattttttatgtatttcctaatttacagcagcactgacaacgtatctctgaaataaagataaaaaatatgaataggcaaaagcactctgtaccaaatatgtccttaactattgattacatatctacctgctaaagcaaatatgtaatcatttagacattttcagcctacaaaattttataaaaagcatatcataatgacacaatgtaacacagtcaaaagtacacaacatatcatcattgactcttcaacatataacctataaacgttgaattctttcatcatttaaaagcacctcacagaaatcatttatatttttctcattctcttgcacaatcttttgagcatctttttgtacattttgtatatttcctggagaagcatcactaaaatcacacgtagaatatatgatatcaccagaaatcctacaatacgtatcctctccttttacaagtctagccatttgataatctatagcatccaaaccagcatcaataataacaaaaagtatcttactagaccaatacaacaacgaattttgcaaatctgaaaaatccttatttacagtaccacatcctacagacaaacaacataacttttcatttggatataatacttgtgctccagcatatgctgctattatagggttattacatacaatagaactatcaatcaataatgttttttttaccctctacaattatttttttaggagtaaaataagtaggagcagctacagcaccccttgtcacatcagatacttttatatcatgatacttatctacccaacttctaaacattactgtttgattagaacataaatcataacttggtacaataaaatttgtcatcaagtccttcattgcaacatccccaaatatttcttttagtactgaattcaaatttttatcagaatatttaggaccaaaaattaatgcaaaagcatttctagcagcagaattggaaaaaattttaccagaatactttaacatcaagtctaataaatcccttgtattatatcttggcataccatcagcattcttaaggcaaagcgctccacctacaagactaccaactgaactacctgatactaagtcaaatatcttacttaacggtttatttattctcttttctatctcttgtagtatagttgctgctactatgcccctaactcctccaccatctatcgataaaatatatctagtcataactatatcctccatattattaacttgttaataaatacaaactaatatcagatttgaaataatataaaacaatacagctgatacgtacaactttttgttgagcatatcaatacaataacccttcttttatgaaaaattaaactatatttcctaacatacaatagattatatatttggtaacatttatagtattttctgtgttcttaactatttttacattacttattaactttttaactaaaaatactaataaaacataatatgactctacatagatttatcaagaaaagtactactatgtagaatgcatttcatacatcagtaaaaacacatatcaaatattaaagaacttattaaaaaactaattagagattaaagattcaagaaatcttattcattataaattttgctcctatctctatacaagcattacttatgctatgatctaaaccaggaattgcatgactttctaaaggcacattatgatctaacaaaaatccaactgcatcattaaaaaatgagaacggcactacatcatcttctgtaccatgaactatacaaatatcaggttttacatttatattatgtttcaagtaatttggacatattatagcccctgaataagatattacagaagcacattttcttttcctcaacaatgctatatgtactgctaacattgctccttgagaaaacccagctaaaactaacttatcatcactcaatccagtatttttcaattgtaaatctataaaattattcacaatcaaagctgttttttccatatcagcaaatatcacatcttcagaaaaatcacgtccattaaaccatgcataccctgcatctccatacttcatatgagcattaggagctataaagtgagcattaggcaatagttcacccattaaacgtcctactgacagtatactattaccagttgctcctcttccatgaagcaatacaaccaaaacattagcacagtcaccagaagtaaaactaggtccatcaataactatactcataatatctctccctatatattaaacaacttaaatgataggtcactacttactgaacaaaaaacattattgcataaataacagtaatagcatgaccaatacaaaaaatttttgtactatagctacactacaatcaaatcacacaaattaaaatacttatacttacatcacactttaacatacgcatgtaaaatacaaaactaatacaacaatcttactttacccaacataagatattcaaaccattacttatacttattttctactatgcactatacatgtttgtaactctttatcaaactctaacaattttttccattacaatatcttataatacaaaatatacatcaatgacttaaataaccatattattaaatatcattgtaatttttagctatttaccgataatacctcaataaaccataataaaaagcaaccatatcaaaaaccctttatggggaggaaggtttttgtaactctttacaaactttaacaattttttccattacaatatcttataatacaaaacatacatcaatgacattaaataaccataaaataaatattattgtaatttttagctatttacgataatacctcaataaaccataataaaaagcaaccatatcaaaaaccctttacggggaggaaggtttttgtaactctttacaaactttaacaattttttccattacaatatcttataatacaaaacatacatcaatgacattaaataaccataaaataaatatcattgtaatttttagttatttacagataatacctcaataaaccataataaaaagcaaccatatcaaaaaccctttatggtggagaggaaggttttttgtaactctttacaaactttaacaattttttccacattacaataccttataatacaaaacatacatcaatgacattaaataaccataaaataaatatcattgtaatttttagttatttacaagataatatctcaataaaccataccaaaaagcaactatatgaaaaatcctttatggggaggaaggtttactgtatcccccagtgacattatgaaaaagattaatgaatcaatatcgtttgacaaaatactatatgaagaagatatatctgggtcaatagcacactgtaaaatgttagttaaccaaaaaatcattagcaaatatgaaggtcaacttattattcatggactagaagttatacaaaaccaaatttcatctggcacttttgaattcagcacagacctagaagacatacacatgaacatagaacaccacttaaagaaaatgataggtaacattgcaggaaagttgcatactgcaagatctcgtaatgatcaagttgcaacagattttaaactttggatacggaaatcaatagtaaaattagaaacgctattacatgaattacaacagactatacttaatatagctgaagctaattacgatactatcatgccaggatttacacacttacaaattgctcaacctgtaacattaggtcatcatttaatggcatattttgaaatgttaaaaagagactgttcacgctggcaagatttacacaaacgcatgaatcaatgtcctgcaggatctgcagcattagcaggaacatcttttccaatagacagacatttcatcgcacaagaactaaaatttgacagcccaacagaaaattctatagatgcagtatcagacagagactatgttattgaatttttatcaaatgcttcaatatgcataatgcatttatcaaggttagcagaagaaattatactttggtgcagctacaattttaagtttataacactttccgataatatcacaaccggaagttcaataatgccacaaaagaaaaacccagatgcagcagaacttatcagaggaaaaactggaaggatttttgcatcattaaaccaaatattagtcgtcatgaaaggactaccactagcatatagcaaagatatgcaagaagacaaagaacctgtctttgatgcagcaaacaacttaatgttatgtatagaagcaatgaacagcatgttaaacaatattaccattaacaaaagtaatatgctaaaagcagcagagcatgactattcaacagcaacagatcttgcagactggctagtcaaaaatcttaatctttcatttagagaatctcatgaaactactggacaaatagtcaagttagcagagcaaaaccactgtaaactacatgaattaactctagaacaaatgaaaacgatcatcccttctataactgaagacgtcttttcaatattatcggtaaaaaactcagtagacagtagaacgagctatggaggaactgctcctgcaaatgtaatcgaagcaataaaaagaggaaagttatatctcagcaatattactactttacattcagaaaacaatatgtaattttttctagcaatcagtacctattacacatttagagaaaatgcagtacatgtaaactagatatagcaagattactgttttgaagaatactactcctattcatttttatattaaacacatgcaaaccacacctgagtactgaccttatatctctaactaaataattaagtacaagtgccacattcaatatagaagtctatgcaatatcaaatatcataatctaacatagactttatattaaataagaggacctaattaactagatcaataagctatttacagtctatcaccttattaatcttactttgattgtaacacacacatcagtattttattaaatgctatttagcaccgttatcatatgtataatgcatttttaaataattcactgttttctgtgagaatatagcactacttacataaatttcctataaataagaacatcattttttatttacaagtaatatatgtactacactatgatcttcctgagaaatactatgtacacaattattttttatattatctacaacattagctaataatattccatttaagtgatcaagttcatgttgtatacatctagaaagccaaccatagaccctcactatacattcattccctaacaaatctgtatacctcaaatccatatgttttggtcttgtaatattaatcaatccataggatttagcagatgaacatccttcaaataaatcaacagtttcagcagagaagctgagaacttcaggatttatacatatcatatttttaccatgtaatgaatgatgtccagataaaacttttatatcctgtgcaatatcaaataaaccactaaacatatttatgataaacattctactatgattaccaagttgaactgcagataaccctacagtcttactatgttccataaccttcatcatatcattagctaacgctataatttcttgatctatcttttcaatagggtgagatatagcatgcaaattttgtaaatcttgaacattatcaacagataagatattcatattatattcctctcaacttttagtataagcaatttacagtataattctatatatttcattatcttaacagttgttatacacatttattagttatataagtagtatttttataaaaaactgatataatcagtgcatattaagtataaactaaccaccaaatattgtgtcactacaacatatatttaccaatccgctattttgtataccaccagaaattgcacataaactagtaatttttgcactaaagaacaatttcatccccacaaaaaaaattgaaattccaagatctcttaatatacaagtcttcaataagcttctcagaacccctataggggttgctgctggttttgataaaaatgcagaagtaattcaacccttattgtctattgggtttggatttgttgaagtaggaacggtaacaaaacaccctcaaaatggtaataaaaaaccacgtgtacatagattaattagtaaagaagcaataattaacagtctaggctttaataataaggggataaatttcttaataaagaaagtaaataacattcaacttaaccattgtatatttggaattaacataggatttaacaaaaaatccagtgatcctatccaagactatttcgattcagtaaagaaagtatatggtctaagtaattatattacaattaatatatcatctcccaataccccaggattagatgagtttcaaaaaaaagatcttctttcagaattattaacagctatatctcaagttcgaaagctagcagattatgcagaatctgttcctataatgctcaaaatttcaccagacattaatgataacaaaaaacaagatattgtagatttagcaataaaatataaaattagcggtttaataatcagtaacacttcatcacaacataacaaactattaaatatgaatacaaacatacatggaggattaagcggaaaaccactatttgatttatcaacacaagtattgtctgaaatatatcaagcttcccaaggaaaacttttactaataggatgtggtggagtaagtactggatatcatgcatatgaaaaaataaaagctggtgcatcattagtacagttatacactgctatagtttacaatggattcaatatagctaataagataagcttagagttagctgatcttttagccgcagatgggtttcctacagtacgccatgcaataggccataatcactagcaggtttaacatgttaatagcaatagatataggtaatacaaacataaaattagcaatctgtgcaaacaataaaattataaaaaggataactatctcttcacaatctaggagaacagctgatgaatacttcatatatttaaattctacaatgaatcaattaaaccttgattacaaaaatataaataatattatcatatcaagtgtagttccaagtataacaaagccaattatcgaattaagtcaaaattattttaatatagatcccacaattttgagtaaccatcatgcagacatttttaatattaagataagcttacaaaacaaagtattaggatcagataggttagcagatataattgcagcaagcagtttatatccccataaagatttactcataataggtatgggaactgcaacagtatttaacttattaaataaagataaatgcatatatggacaagctatagcacctggagcacatattttagcaaaaagtatgagacaatacactgccctattaccagaagtattaatttcaaaacaagacaaagtaatacatgataatatataccacgcaatggaatcaggaatatactggggatatattaccatgattaacggaatgattgaaaaaataataaaggaagaggaaaaagatttatatataatagcaacaggaggaaattctaacttattctttaatcacaaaactgctattcacaacatcgaagtagacttaaccataaagggtctcatacaattacatactgtactatcttgataccaaaccctgaaataatataactcattgctaactgatatgatatagtacaataactaaaaaggacgaggaaaaagacttatacataatagcaacaggaggaaattctaacttattctttgccacaaaattgctattcacaacatcgaagtagacttaaccataaagggtctcatacaattacatactgtactatcttgataccaaaccctgaaataatataactcattgctaactgatatgatatagtacaataactaaaaaggacgaggaaaaagacttatacataatagcaataggaggaaattcaacttattttttgaccacaaaactgctattcacaacatcgaagtagacttaaccataaaggatcttatgcaattacatactgtattatctggtacaaaatctgagaacaaataactcattgttaacttatatgatgtagtacaataactaaacgttatttttaacaacaccattattataattacattgctgcttagatatatttgcagatatctctttaatcttttcaactacatttgtacttgcatgtaacaatatatccgacaaaatatccttatcaatattattagctattaacattaatgaatctatatccaacaattcaaagacttcagcagccaattctacaggtatactttcatatatttttactaaaccatgcactttttcatcataattttgagtactaatattaatcaatgatactaaattttttttcatctcttctaaatataacatttgatcattattatgctgcccagcaatttttagcaaagcctctttatcttttaaactattttcttgctccaacaagcgataataccaatcctgcaaatctacaacagatataagctcactatttactggaaacaattttattttttgatttgaatctctaaaaaaacaatcatcactttttacaaattccacatcattcaacaaaccaaattccacaattttatcattatcaatgccataaaaattatgtaatacaaccccagttatacagaatattaatatcacattaacaatataaatcacttgcatactattaataaaactattatacaatgccttagaatcaagtatgttataataaaacactattgtgatttagcaataaataattagtagtatttatattgacactgcttatactgcttatatctaaaatactttaagaacataaaattaatgaaggcgtttttcacattgttcatattttggtttgccctatcagggtatcttgatctattttttataacatcaggtattacaagctgtattattacactagtcatagcaagaatgctacagaatgttataccagcaaataagaattacacttactacatatcaaaaaaacaattccttcctttcacatttcactttttacgttattttttttggatcatgcaacaggttgtactgtctaatatacacataataaaaaaaatatggaatttgagtataacaatcaatccaccaatttttagagtaatagaaaccaagcaaattaccggcttaaatatatcaacagttgcaaattctattacacttactcctggcacagtaagtataaatgttacagaatattctagcccatacaaaataacagttttagctatagatgaagagtcaatgtctggtgtaatagatattgataataaaattgcaagtatataaatcttcaataaatactcgtaataatagacaataatatatcctttggtgttcatacaacaatttagtaattgtcatagaaataatctaaagttgtaaattcatattgtcattaaatctgacaagtgattaattttgacatcatgaacacagtgactaacttgctgcatatgactaccctgatctatgttaattgcttgattacacagagctttggtttgtatactttcagtatctctctcaagcacttttttattcattacactttgtaactctagtacatcaaggtcacgagataaaaacttgacttcacaatctatacatgcattactaagtttaaatattctattttctttaatataaaaattacattcatgcgcacataaattactagtgtcaataattccattaataaatacgtgctttattccccttagaaaaaaattacccttagcaatggaagaaaaatataaatacattccaagcataacaactacacaacttcctttatatacatttccccttagtatgacattactacttcttacttcaatattaccataaacattgccacaaacttccactacactgttttcaacttttactattgaagatttttctacattacctgcaatgaaaaccatagatgtatctattccactgtgtttagcttcaatactcccactaactgatccctcaattcttactgaatcacgacacgacaacaatcttcccttcacattaccatatacaaaaacattattacaatgcaaagtcacatgtacaggaatgtcaccttttataattacattactatatttagatgcatctaaccgacaattaccactagcagatttaaaatacttaaacgagacaattaaattatcctttactacaaatgaatcaagattctcttgagtaatactttctaaatcgataaccttaaagacctctcttaacttagcaacactacttacatttatcgtacctatatattgttgtattttacattttacataatccttaccaacacaaaaatatacacccttcatttctcctttatgaaataaagtatgaataggtttcacataagaacctacccagcacatatcttgtagattcttaacatgtaaaagtaaattttgacaattaggcactgaagtaattttgttataatacaaatgatatactgaaataatcattttataatacaaacgacacgactttaaatcgttcataataacagattcacacttatcaaaatttgggttatttattatacagaacaagacccaatgcaataagatactatcatcttgcatagatagtttatctgtaaactttaaaaccgtgctgacagatttacgcaaattatcaaatgtattttttacaaaatcccctaacataacatcattataaattacatacctacagcttaaattactccctttgttaaatatagatctcttcaaacttgaaacacaaccaagtgaaacatcttgtctacttgaacagtcatatgatcttgcataatcaacaagtaaagggcgttctttagaatacaattgagatacacctctaaaagactgtgattttctagtcccactatttgttaacacaacatccgaacttttacattttatatgaccagcaatatcatctgtgacattaatatcttgacaaaccataatattttcaaaacgttgttcaccacttattctagccgaattacttcttcttaaaacaacgtctctacttctactgtagcttcttatattagatctcaaatgcttacttatagtaccatgcaattgttctgatactacagtctcttcaatttccccctgatttctggtattcacataagagataaactcttgtaataaatgcattggcttcaatttaccatccttacaataccttataaaaacaccttcatcatctttcataacaacatcacttaggttactttcaatatcaaataaagacatagtagggaacatatctataagagcatccttacctatttctggaactaataccttaactaatcgatcaataccacccacatcatcaatcaatatttttaacaaatcattcctaccttcttcacttttcatgtactgaaatacttgatgatttacaagcgtacacatcttatcagaaatacaatctctttcactagtcactccatcttgtacaacaaagctactttggatattacttgagatactctgaccgcattctaccttaacatctgaaccaaagtgtaacgttgcagactccaccagctgaccagattcacttgtaatagtaaaatgaccatctattgacgaaaagaaatcaacgttagtttctccactagttgatggaacactcatatcagttattctttgatcaacaacattcacaggtataggcttttttaaaggaacatcatatcttgagccatctgctacactgctagtactattcaatttgtcctttccaaaatgttgactactactatcatcaatttttgaagaatggatattgcattcctcaccacatgatggaacattcataccactcatcttctgatcaacaatattcacaggcataggcatctttaaaggaacatcatatcttgagccatctgctacactactagtactattcaatttatactttccaaaacgttgactactactatcattaatttttgaagaatggatatcgcattcctcaccacatgatggaacatccgtaccactcatcttctgatcaacaacattcacaggtataggctttttcaaaggaatatcatatcttaagccatctgctacactactagtactattcaacttatactttccaaaacgttgactactactatcattaatttttgaagaatggatatcgcattccccaccacatgatggaacatccgtaccactcatcttctgatcaacaacattcacaggtataggctttttcaaaggaatatcatatcttaagccatctgctatacttctgccatctgctacactgctagcactacctgatttattttcctcaaaacattcatcactaccataactaatctctgagaattgagtactatattcttcactcgttagtaccacatgttcaaccgtttcattcatatctatagaatcacacgattctctttctcttgagctagacacactttgataactcatcctagataatctagatctcttttgatttaacatatgatttagaatcaatactttaaccaatctagggtcactaccattctgacatatgcttgattctatggctgaaaattccgactttttttcttcattttccaataatattatattcaacacactatttaaccttttcaatatcctaaacatattatccagagatatttgaaaattatgtatccctacttttacatcgctaaattgttcagaaggaaaatctacagaactcgccataaattgattagaactatgacattgccgttgcaatcttagtaaaatattttgcgtctgtctcattacacataatacagattccatctgtccgcctatcaacaatgtgttaccatcactaacaacaccaagaccaccacccatatcttgctgtttacttacagagcctaccccagtagaagcagtagcactacctgcactttctattgcttgttctgaagaaacagctgcatctgataacaaaatattattaatactaaagtaattcgatacaagatcttcacacaatttacacagcgtatcttcactgattacaatattaggtaccttttccaataaacgcgattgacatccaagaaaaatactcaagtcatattgaagatagctcaagtcataaaaaaaacttgtcatacaagaagagcacaaagtagaaaagaaagccctactatcttctttagacaactgattaataagatcacacatttcaatatatacgtgtcttaccctatcatttaagtcttttataatctctttatgagaaccaaattgaacaaaatatctttttatcatatacggctttcgaccattaaaatcagtaatagtacggcttgttttatcacattgagtagtacattgcgggatagaacgttctctactactatcagtaacacaatattttaacatcagcacaaactcaaattatcaaaaattttactatgataattaatatctttactatttttatacaaaagttccctcatctattttccattaaacaattgtcagctcttacttacacatccgcattaaacttataaaattgattggtaaaaacttacgcaatacaaagctgtgctcaaataaacacaagtatattgaacactacttaattagctcactaaacagtacactacagatcaaaactcttaaaaaagcccttgtcattataaagttagataaagccatagttagaatctagaactaaattatcaacagactctaatatcatccttcaaacaacaaaacagtacattcttcaatattaatcaaaaatatgctaccatatttaaaaaaaccgttatatcaattttctttatacaacattatttacacaaatttttctacctttacactaattaacatataagcatgctattatatgaataagaaaagataatggtcaatataaaaattaatataataagtaaaaatattaatatcactttgtagctttcatttaaactacaactttctataatatgtattaatacataatcctctacctttaaacgctaaaaaactttcttcacaagcaaatctaaagtataaatatactttacaactaatccttactaaaacctaaaataagctttatgccagatttttctatagaaaatgaaatatcaaaattaataaataataaacactgtactatagtaggagttgacgaagtaggatatggttcattagctggccctgtagtatcagctgctgttttttttccaaaacatgacaatcacatcacatacaatattcaagattcaaaaaaactcactccaaaaaaaaggctagaaatttataatataatcactcctatggtaaaatggagtatagggcttgctgaagtgcatgaaattgaccagtataatatactaaatgctacacatattgctatgcaaagggcacttagagggttaaattctaatatagattatgtaatagtagatggaaataaagttccagagctaccatggaatgcaaaagccgttgtagatggagataacataagtatatcaattgcagcagcatctataattgcaaaagtcacacgagataaactaatggaaacactacacatacaattcccacaatacaactggaacaaaaataaagggtatggtactaaacatcatttagagtctttacataagtatggtaaaactatacaccacagaaatacatttgccccagcatcagggataactaaactttacaataaatgataaaaacctcactactattgatttaaaacacactctataaattcacactatactctaaataccacctatttaatcaacactgtataaaagtactcaacttctaatttccttaacaccagctatttataaagttattatacaataagtaagataccctaaatatgataaaaaaagtaatactactagtttcaacatttctactctgaaatatcctgataatacattaactatgcctccccatactggaatccaagaacatagcaatgttaacaacattaaggctaactttatataaacacctaattttccataatcatcctgcactttatgatactccacacgtgcaaaaattatcattctacccaatacccagttaatcacccctcctataactgcacctaacgttgatactaaaagcatcaaaggataactataacccccaaaataagccattattttaaatatcaatattttatttaatggtaaaataagagcagctacaaaactatcaacgaataataaactataaatttctatcatctatagatacactatcacatattccacgggactggtgcgatttgaacgcacggccttcggattaggaatccaacgctctatcctactgagctacagccccaacacactttcaatcatatagattatctatacaatgtaaacaaattttcaactcttcattccaaatccacagcagatatttcatataataggcactttgcacttccttttattttattaatgtcataacacaaattttacagagaattcctaaagtctctttagcatctattattaatattcctaaattatcaacagactctaatattattattcaaataacaaaacaatcctcattccaatattagccaaaaatatgctacgattttaaatctacaaaaatattctatataacatgtaattaaatatgagtaacaccacttaaaccttcttcaatattaatataaacagtaacatgctttacttttaagtgataataaacagatctacttatcactgttatactaagataaatattaatattatattttcatgcaatagcagttgtttaggctaacttatttcattttataacttcacaattaatacaaacataacatgctttactttttaatgataacaaacaggtccacttatcactgttatactaagataaatattaatattatattttcatgcaatagcagttgtttaggctaacttatttcattttataacttcacaattaatacaaagtaacatgctttactttttaatgataataaacaggtccacttatcacttttatactaagataaatactaatattatgttttcatgcaatagcagttgtttaggctaacttatttcgttttataacttcacacaatttctctatatctgataagctatgattcacactaaatacaaatctcagtcttggagtcggtacagtaggaggacgtattgccacaacaagaaaacctgcttcccttaacacttgctgtgcatgtaaaacgctattcatatttttcataattaatggtactatatgactactaggttcagcaagattcagatttttacaaaaaaatttagccaatttaataggtatatcattaacagatgcacttataatatccaacgcagcattcgcagcagcaataaccatcggaggtagagcagtcgtatatataaaagttttagctttattctgtatatactttataacaacctccgatgcacatacatatccacctaaaacaccaactgctttagataaagtaccaatgtatatatctgaattagcacaaggtattaatccaaatccatgagcacaatccacaataagccacgcactatatttttccgccaatttttttaactgatcaattggagcaatatcaccattcatactatacacttgctcaactacaataaaacagtacttatgtaacctcctatatttttttaatatatcttcacaatgtccataatcattatgctcaaacctataatgcttagcagaagaaagtttaataccatctataatagaagaatgtactaatttgtcagaaatgatcatatcatgtctatgcactaaagcagaaataacacctacatttgttaaataaccactactaaatactaaagccatttctgtatgatataactttgctaatttatcttctaagcattgataaaggatattattccctgtaaccatgcgtgaggcaccagcacctacaccataattatttatcgcatttatagctgactcttttaataaaggatgacctattaaccctaaataatcattacaagagaaggaaactaatctctcgttattttgacaaaccaaacaacctacttcagatctagttacagtagaaggttctctatataaattatcaacctttaatttaataagttcttgatttaatatttcatccaacatatgaaaaactccacagcactgtaacttaatatttatcagctacccctattttggacttttgacaaaatacactcaaatacaagttctcactacaaaaaaaccctatcgaaacatagtaagaagtaataatttactttacatatcatccttttaattgagatgcacccacaaacagaaagaaacactaccatataatttacatctcttcacaagaagaagaaccacctctccacccatcaataattaagacttagatgctttaataatcaacaatatttccagtatctttatgcagttcctggttaaaagcattattatcattttggagtaatgctgaatcttgatattcattattataatacatagaatagtcctctttatttaataaagacaacttctttatcttattcattaagaaccctgtacctgcaggtattaatcgacctactattacattctcttttaacccatataaagagtcttccttaccagaaaaggctgcttctgttaatacttttgttgtttcctggaatgacgctgcagaaacaaatgagttagtatcaagactcgctctagtaataccttgaagtattggagcatatttagcaggagatttacccatttttaccatattatcattagtctttattacttcttccatgtctatattttcaccaaccaaatacatagtgtctcctggttcaaatatttcaactttttgcaacatttgtcttaagattatttctatgtgtttattatcaatacgcacaccctgtaacctataaacctgctgaatttcagaaatcatataatttgctaatgcttcaactcctaaaacacgtaatatatcatgaggatcaggatcaccatccattaataaatcccctttatgtacaaaatctccctcatttacaatagtatgcttacctttaggtactaaatactcaacaggtgataaggtatcactgactggcttaataaatatacgtcttttagatctataataatcttttccaaattcaacataaccatcaatatcacttactatagcatgttcttttggacgacgtgcttcaaacaattcaattactcttggtaacccccctgtaatatctctagtttttatagaatctcttggaattcttgttattacatctccagcatgaactttttgtccatcctgaacatttaacactgcccctattggtatgaaataatttgcctccaaaccattggataatgttattatattatcattatcatcaattagaactaacctaggtctgaggttagcaccctgtaaatgtaatttccaatcaactactactctgttagaaataccagtagattcatccaagacttcattgatagacacaccatctattaaatccatatacttaatgatacctgttttttctgtaataataggcattgtatatggatcccactcagcaattttttctgtaatttttactaactgaccatcatcaacataaagtcttgctccataaggtacattatgacgcattttttcattgcctacactatcaagtaacactacttcacaagatctactcatgacaatcttattaccatgcttgtcttcaacgatattactgtttactaactttaccttagcatctaataacgctattaagtttgaagtttcaacacctctcattgcagtaccacctacatggaaagtacgcatagtcaactgtgttccaggttcaccaacagactgagctgctattacaccaacagcttcacctattgatacaacatcaccaatagcaagatctctaccatagcacaaagcacaaatacctttcttcgcttcacaagtaagaggagatctcacttttacagcatctaatcctgctatttttattttttcaactttagcttcatctattaactctccagctttaacaagtaactcttcagtaataggattataaacatcaacagcagcaactcttccaagtattatattatctaatgtttcaactacagtcccaccttcaacaacagaccttattgcaaatccattgtgtgttttacaatcgtactcaacaactatacaatcctgagcaacatcaacaagcctacgagttaaatatccggaattcgcagttttcaaagcggtatctgctaaaccttttcttgctccgtgagtcgaattgaaatattcaaatacattcaacccttcacggaaattagatattataggagtttcaataatttcacctgatggtttagccattaatcctctcattcctgctaattgtttcatctgtgatgcagatcctctagcaccagaatgagccatcatgtaaatggaatttaatttactttctacatcatatacagaaatagctttcatcatatctttagctatcaagtcagtacacttagaccattcatctattactttattgtatctttcacttcttgtaattaaaccatcttgatattgaacagcaaattctttgattttttcactagcattatctacatgcattgtctttgtatctggaataatcatatctttacatccaaatgaaataccagactgcgaagcatatttaaaaccaagagacatcaacttatctgaaaattcaacagtctcactttgaccacaactacgatataccaaatcaactatagatgtaatctcttttacagttaaaacttgatttattaaatcaaaagtcaaatttttatgttgtggaaatatctgccataatatcaacctaccaggagttgtttcaattattttagaataatatgaaggcttcccatccgatgtatcataattacaataagtcattctatacttaatttgactacataaatgcacatctttgttatgtaaagcgtattccacatgactaaaatcaccaaagaataatatctcatcttcagattgaacttgatcttgtaaagttaagtaatatattccaagcactatgtcctttgaaggaacaattattggcttaccattagaaggacttaagatattattagtagacatcattaatatcctagcttcaagttgagcttccaatgataatggaatatgtactgccatttggtcaccatcaaaatcagcattaaaagcactacacactaaaggatgtaattgtattgctttaccttctatcaaaactggatcaaatgcttgtatacctaatctatgcaaagtaggtgctctatttaataatattggatgttcatgtattacttcatctaagatatcccaaacttctggcttttcattttgtatcattttatttgccaattttactgttggcacaataccatacatttttaactttgaacaaataaacggtttaaacaattctaacgccattttcttaggtaatccacattggtgcaattttaagttaggaccaacaactattactgatctaccagaataatctaccctttttcctagcaagttttgtctaaaacgcccttgcttgccctttaacatatcacttaatgatttcttgtaccctacactccctgccttattagaaacatagctacgacgtgtactatcaaaaagagcatctactgcttcttgtagcattctcttttcattacggatcataatcgcaggtggatttaattttaataacttacccaatctattattacggttaataattgtccgataatgatggtttaaatcagaaactgctggtcttccattttctaaagaaacaagtggtcttaaatcaggtggcaaaattggtataactgttaatatcatccactcaggtttgttaccagaatttataaaattctcaacaatacgcaatctttttactattttttttctcttcatttctgaagttgtagattccaactctactctaagatttgcattaattgcatgcaaatccaaccgcactaacaactccctaatagcttcagctccagttaaagcaagaaaactatcttctccataattatcttttgcttgattgtaagcactttcactaataacttcacccttagacaatggagttgcaattggatcaataactacaaaatcaccactatataaaatattttctatcaacttaagcggcatatcaagtaatgcacctatacgcgaaggcagagatttcaaaaaccaaacatgtgctacaggagatacaagttctatatgtcccattctttctctacgcaccttagatgatgtaacttcaactccacacttttcacaaactacgcctctataacgcttttttcgatacttaccgcacaaacattcatcatcattaactggcccaaaaattttaggacaaaaaagacctcccttttccactttaaacgtacggtaattagtagtagaaatatctttaatttcaccatacgacattgctctaatgctttcaggactagctatagatatgcaaatcttatcaaacgattgcgcaatactagtatagccatacaaatccaacatcttcatatactactacctttaattattaatctttcacttcattacttaagaaatccttatcttgctttaaagcaacatctaaacacaatgatcttaactcttttaccattacattaaaggattctggtattccacattcaaaattactatcacccttaatgatagattcataaatcttaactcttccaacaatatcatcagattttactgtaagcatttcttgtaaggtataagcagctccataagcttgcaatgcccaacattccatttctccaaaacgttgaccaccaaaatgagattttccacctaatggttgctgagttaccaacccatatggaccaacagatcttgcatgtattttatcatccactaagtgatgtaactttaacatgtatatgtatcctacagtaaccttacgatcaaatttttcaccaattcttccatcataaagatctacttgccctgaaacatctaaatcagctaatcttaataagttagaaatttgactatcttttggcccttcaaatactggtgcagccataggcacgccatcacgcaatctttctgcaaaaaccaaaagatcctcatcactcatagactgaatattatcttttaaatcttgcccatcatatacttgatataaaaagtttcttaaatgagataccgtcaattcatcaaggttatctaatatatgccctatctttttccctaaattaacagatgcccatcctaaatgcgtctctaaaatctgcccaacattcatacgagaaggtacacccaaagagttcagtataatatcaacaggagtgccatcctctaagtatggcatatcttcaacaggtacaatacgagaaatcacccccttattaccatgtctaccagccattttatctcctggctgtaaattatgttttactgcaacaaaaactttaactatacacaaaacaccttgaggtaaatcatatccatagtttaatttatctatcttttgatcaaacttactatgagcattttgaatcattgaatcaaatttttctttcaagtccttaacttgaagcaacatagcttcatcagataagttaatatcccaccattccttctttggaatagatgctaaataatcatctatattctgattattatactgtacaccagaactcaccaaaactcttttcaattcatcatagaaatactcactaactacatctatttcataatccctttcttttataaaaccattgatttcattttgtttaattaaaagagatctatcattttcttcaacaccacgacgcacaaaaacatgcacatcaactactgtcccttcaacatcaagtggcaaatatagtgaagaatctacacaatcaaatactttttcaccaaaaatagtaactaacaattttgtttctggaggtaaagaaactggtggtctaggtgtcactttaccaaccaaaatatctcctgcagaaacttcagctccaacattaacaattccaacatcatccaaatgagataaactatcctcattgatatcaggaacagacctcataatcttttccggaccaagcgttgtatctctaactacacattcaaattcttctatatgtattgaagtaaatacatctttctttacaacttcacttgaaataactattgaatcttcaaagttatatccctgccaagacataaacgcaaccaacacattcttacccaaagcaagctcaccttgatcaattgctgatccatcagctataacatcatttgcttttacataatctccaggtttaactaaaggtcgctgattaatacaagtattatgattagaacgttggaatttccttaagttataaatatcaacacctaaatattcatttttttcctgatcaaacgcacgaataactatatacagtccatctaccctatgaacaatacctccacgtttagctaaaacaactgttcctgatcctgcagcaactattgattccataccagtaccaatcaaaggagcatctgcttttaataaaggtactgcttgacgttgcatattagaacccattaaggcacggtttgcatcattattctctaagaaaggtattaaagacgcagcaactgaaactatttgctttggagaaacatctatataatcaacttcttccctcttaaccattacaaaatttccatcatgcctacaataaagcatatcatcaacaaactgattattctcatcaagagtagcactagcatcagctatataataattactttcctgcatagctaacaggtattctactttatcagtaacaactcctttatccacttttctataaggactctcaataaacccatgcttattaatacgggcataaatagccaagctactgatcaatccaatattttggccttctggagtttcaattggacaaatccttccataatgtgttggatgtacgtctctaacctcaaaacctgctctttccctagttaaaccacctggacctaaagcagataatctacgtttatgagtaacttcagataatggattagtctgatccataaattgggaaagctgagaagagctaaagaaatctttcaaaacagtagccaaaaccttaggatttacaaaatcacatggcattgcattatcaaaattgaccgaagacatataatccatgatcattctttcaagtcgcaatataccaatcctaaactgattctcaataaactcaccaacagatcttactctacgattaccaagatgatcgatatcatcaacagaaccttcaccatcccgcaataacactaatttctttatgacatgaattatatcatctttagttagtaccgtaatatcttcactaacatttaacccaagatgatcatttaactttattcttccaacagtagataggtcatatctttctttttcaaaaaataacccatcaaaaaaggcttttatagtatctaaactaggtgattcaccagaacgtaaaactttatatatttcaaacagcgcatcttcataagatacatttttatctaaaaataaggtatttaaaatatatggaccaactgttagaaaatctatatttaaaacaaagatttcctctatattaaacaattctagtttgtttatatgctcgctagtaatattttctcctgcagatataattaaagcatttccagttgaatctaataaatcattagcaataaataatccttgaatttcattaaatggaactaaatacttcgtaagcccatcattagctaattttctagccattcttaaagtaattctggtattagctttcaccaatacattaccatctgaatccataagatcatgagataatctaacacccctaaatctatcagcaacaaatggaacaacccatcctttttcagattttacataacgtattttatcatagaaagtatccaaaatatcattattagataaacctaaagctcttaaaagtaaagagactggtagcttcctcttcctatcaatgcgaaaataaagtatatcttttatgtcaaattcaaagtctaaccatgaacctctataaggaataattctggccgaataaattaatttcccagaactataagtttttcctttatcactatcaaaaaatacaccaggagaacgatgcatttgtgatactatcactctttctattccatttatgataaacgtcccatgagaagtcatggtaggaagatctcctatggaaacctcttgctcttttatatattttatactcttttctgatgtttcttcatctactacatattttacttccttgaaagatacttcctgaaccttccatactataaaacgcagaactatacgtataggtacagaaaaagtaatacccctttttatacattcatactcatcatactgtggctcaccaatactataacttacaaactcaagaacagcccgacctaataagtcttgtataggaaacatagattggaaaatattctttattccactttcagtattttgatctatcccaataaatgcattgtatgaatccctctgtatttttattaaatcagttaacgaatcttttatatctattgactttgcataagataatctaggcactgaattaaaagaatttaatacatatttagtagaagttacagaagaagacattaaaatccctcaagattaataaattacaaataaaagctacattaaaaactatttgatactaacttttgctccagcatcttctagctttttcttgatttcttcagcttcttctttcttatactttttaccttctatcaattcttttgcaccttctttttcaacaaattcttttgcttcttttaatcctaaactagtacactctcttactgccttaatcacagaaatcttcttatctgcagcatagctttcaaaaactacagagaaatctgttttttcttctgctgctgcaccaccttcaacttgattaccgcctgcagccggaacagctgttaacaaaccacccttaggaaaccctaacttttgctccatcttttccactaattctgctgctttacataaatctaagctacaaatttgctccaccaaactatctatatcaacagtactcataataattaaccccaatcataaaaaataaaaaagtataaaattaaaacatagtatcactctttattgccaagagcttttaaacacaaagccaatctcaccggaatattataagatatcatactcattatttgtgcatgtaattctcctaaagatggtaaactagcaaagtataaaattttctcactatctaatacctcattgctatcgtatgcacataataaactcaccttgcttttattacttttcataaactttgcaagaatttttgaaattactatgatgtcatctgaataaacaataaatacagaaccaaaaaacttagcagctaactcttctctgttcattttctttaaagcaatacgagataagctatttttgactaccattaaaccactattagccatttttaattcttttcttagagaaaagaaatcatcagctaccataccctgaaaattagcaattataaaatatttaaacttaacaaacaatccttccactttgcttaaatgtaattctttatcgctacgcttcactacttttactccaatattaattatttaaattttctactttaacagactttcccatagttgaaataataaatacatctttaaagtataaaccttttatagatgcaggtttacactgctttactgcactaatcactgcattaaagttttctaacaaatcttctatagaaaatttaatattcccaatttttgcatgaacaataccagtcttatcagatttaaatttaatctgaccagattttatcattttaatagctttagcaagttcaaaagttactgtgttaaatttaggatttggcattaaccctttaggccctagaattttagcaatagaagaaactgatgccataaaatctggagtagtaagacaccaatctacatccaatttacattgctttttcttgacttcttcaatcaactcttcatcacccacaatatcagccatagcttctctagccatttccaagtacccacctttagcaaacactgcaacttttatttctctccctaaccctttaggtagtacaacacatcctctaacttgttcatcagatttcgaactattaatattaagatttattgcaacatctacagattcacaaaaattagctttagcagattctataaccttccttaaacctgactcaacatcataaacttcattactaatcaatgaattcatataacttcctctactacaaccactactactcaattattcttctactacaacaatacccatggaagatgctgtaccgataaccattttcgctgcagcttctacagtatcagcattcatatcagacatcttgcgcttagctatttcataaacagctgacattttaattttcccaacattgtcttttccaggatttactgaacctttatcaatcgcagcagccttttttaataaataagacacaggagaatcgcttattgtaaaactgtaagacttatcattataaatagatatcctagcagtgactagatcaccaactttatattgcttaccttcaccacttgtaatatcattaaactctttacaaaacttaggcattggtataccacgaggtcctaaaacagaagctattttaggtccaggattagctttcccagcttctatcatcaaatttatcttagatactaaaacagcactcacgattatccctccactttttgtatatgctctaacttaaattctatcttagtcagtctaccaaatatcatcacactgactcccgctattttcttatcatcattaatatattcaactttaccattgaaatcttgaaataatccatcattaattacaacttcatcaccaatttcaaaattaacaacactagtatcatctactacactttgacacattttcttacgcatagactccatttcattttctgaaataactttaggaacaccaaaatcgttatttaaaaaattcaataccctaggtatactcctaataaaattcattgaattttcatgtaaactcatatacaaaaacacataccctggcgacaacttcctttttaccaatacctttttattatgttttacccgagtaatttcttcatatgggataaacacttcacggaaactctcttccaagcctaatacccgagaattttccaaaatagtttgacaaactttctcttcgctaccagatgatacctgaataatgtaccattcatatttcataaattaccccaagtactatctttatcaacttcaaaaataaaaaatccacacaacaaaacaaaacagacataaaagtaattattaatattactataaataaaaaccctataacctcatttttagaagcccaagaaacttgtaaagcttcctgttttaccccaagtaaaaacttagcaatattattcattatcagactacctacatgtcatatcactaaaactaaacggcaggagtgataggaatcgaacccataaccttcagttttggagactgacgctctagccaattgagctacactcctattaaacatcaatatatcactactccaaaatttcagtaataataccagagcctacagttctaccaccttcacgaattgcaaatctcaatcctttatcaatagcaacaggcttatctaaacttacttcgatacttatattatccccaggcattaccatctctaccccctcaggtaattttatactacctgttacatcagttgttctaacataaaattgtggctgataatttgagaaaaacggtgtatgccttcctccctcttctttctttaatatatatacctctgctttaaatttcttatacgaatgtatttgaccaggcgcactcaatacttgccctctctctacatcctctttctttattcctcttaacaatatacctgcattatcccctgcttctcctgcatctaatgctttatgaaacatttcaacacctgtacatactgtgctctgtatatctcgtaaccctactatctctattttatctcctactctaattactcctctctctattcttcctgttactactgtacctcttccaggtattgaaaatacatcttctattgacattaaaaatggcttatctttttctcttgttggtaaacttattttttctaaggcattcatcaattccattattttttcactccagactcctgaacctgtttcttcttccaatgccttaactgcagatcctcttacaacatctatatcatctcctggatatccatattttgataataattctcttatttccatctcaactaatgacaacatttcttcatcatctacaacatcacacttattcatccatactactatatcttttactccaacttgttttgctaatagtatatgttctcttgtttgtggcattgctccatctgttgcagatactactaatattgctgcatccatttgtgcagcacctgttatcatattttttatataatcagcatgtcctggacaatctacatgcgcataatgtctattctctgtttcatattctacatgtgctgttgaaatggttattcctcttgctttctcttctggtgctttatctatttcgtcatactttacacttttattaccttctccactcaacctcttcgctaacactgttgttaacgctgctgttaatgttgtcttaccatgatcaacatgccctattgtccctacatttatatgtggtttcctttcttctaccataacattacacctattatttagtttttatctcgtttgccactatattatcaggtacttgttcataacaagaaaaatacatgctatattgtgctctaccctgagacatagagcgcaaatctttaacataaccaaacatttttgccaaaggaataaatgctaatattactttagtattgtgacgatcttgcatttcagcaaccctacctctcctactattaatatcacctataacatcccccatgtactcatcaggagttattatctcaactttcataataggttcaagtaatattgcaccagctttgttcaccatatctctaaaagcaccttttgcagctaactcaaatgctaatggactagaatctacttcatgaaatgcaccatcaactaatgttgctttaaaatcaataacaggaaaccctgctaacataccacttcctctaatattttctaacccattttgaacacctggtatatattctttaggtattgcaccaccagtaattttactttcaaattggaaaccagaaccaggaggtaatggttcaaataatatattcacctttgcaaactgcccagcaccacctgtttgctttttatgaatatattcaatttcaacagatttagtaatagtttctctgtaagcaacttgcggagcacctatattagcttcaacattaaactcacgacgcattctatctacaataacttcaagatgcaattcacccattcctttcaagatagtttgtccactttcaggatttacacacataccaagtgatggatcttctgcaactaatctacttaaagctatacccattttttcttgatccgctgtagattttggttctactgcaatctccataactggttcaggaaattccatgcgctctaaaattataggttggtctaaagtacataatgtatcaccagttaccgtctttttaagcccagctaaagcaacaatatcaccagcttttgcttcagtgatatcctctctattgttagcatgcattaataaaattctacctatagattctgtagaatttttaactgcattcagtactgtagtcttacttgataaccttcctgagtaaattcttataaaagtcaaactaccaacaaatttatcagtcattactttaaaagctaacgcaacaaatttaccatcaatagaagacttaatgtttatagtattagaagtctttacatcgagagcttccatcataggaatatcattaggcgcaggcaaaaaatcaacaacagcatctagtaatggctgtactcccctgtttttaaacgcagaaccacacaaaacaggtacaaattttgactgaattactcctgcacgaatacaacttttcaataaagaaacagatatttccttaccttcaaaatacaaattcattgcttcatcattaagctcaactgcactttccagaagcttatttctatattcttgagctttatcaagcatatctttagggatttctccataatgaaaacttgctcctagagaatcttcatcccatataattgatctcatctccaataaatcaacaacaccaacaaaatctttctcaattcctattggtaattgcaatactaatggagtagcacccagacgttcaacaaccatatcaacacaccgataaaagtctgctcccatcctatccattttattcataaaacaaattctgggtacattatatttatcagcttgacgccacactgtttctgattgaggttcaacacccgcaactccatcaaagacagcaacagcaccatctaaaacacgtaaagacctttctacctctatagtaaaatcaacatgaccaggagtatcaataatgttaatcctatgaccattccaaaaacatgtagtagctgcagaagttattgtaattcctctctccttttcttgctccatccaatccatagatgcagcaccttcatgaacctcaccaattctattttgttttccagtataaaaaagtatacgctcagttgtagtagtcttcccggcatctatatgcgccataatccctatattcctacacttagataactcgttatctatgctcacaaacttatctccaaaaattaatattaattaaagcgaaaatgagaaaacgctttatttgcttctgccatcttatacttctcttccctcattttatacgcaccaccacgtttattataagcttctaacaattcattacacaaacaatccatatacatcttattactacgtttccttgctgctgctgctgctttaaaaatccaacgcaaagctaatgaaactgccctatcttcctttacttcaacaggaacttgatatgttacaccacctattctacgagaacgcacctccatttgcggcattacattgtttagagcagcactaaaaattgacatagcactttcaccaagacgagactccgctttgctcaaagctccgtatactattttctcagctatagatctttcaccagaccgcataataacattaatgaaacgtgctaataatacactattatactttgaatcgggagaaataacccttttagttgccctacgacgacgagacatacattaccacattaattaacttttcttcacaccatactttgagcgcgccttcttcctattttgcactcctctagaatccaatgctccacgtataatatgatatcgaaccccaggtaaatcttttacacgcccacctctaattaagataactgaatgctcctgtaaattatgcccctcaccaggtatataagctataacctcactaccataaccagcaatttttacacgcgcaactttacgcaaagctgagtttggcttcttaggagtagtagtatatacttttacacacactgctcttttttgcggattatgttgaagtgcaggcgccttatttaatgaagaacgagattttcgcggtttgcggactaattgatttattgttggcataatgtaataaccttacagtttattataaaaacagacacaagtagcaccatgtatcttaacttaatggaagcatgcgttacttataaaagaatcatgaaccttagtcaatagaaatttaacgatttttcaaaaactaataagcttaataatacaaaatattatcaacaactcaagtattctttataaatatactattaaaaattatttgcaacctatatttattctttcctatgttttaaacaatatagaaatacttcctttcaaaataatctattatgacttagtataaaattgcctgactttttcaccagacgaattataaaacgtaaccataacattatctacatcttttgactcttgtatttcaactatcgtaaaaccaaaacctaagtcactttttactgtatttgcaactacatctcccatttcaacatcctcaaacaataacatatctttaggaacagcatgaagcagagctccactattaccaactattatttgcataggtatatgtttttgcttcttagattttaaatctagtacctgagataaatgcacatgccctgataaaatcacagaaacattatcaggaaacaaatcaccaaaagcttcttgctgagctagattaccataataaagattccctgctttacctttcaaaacagcatatgaccacacaggacgatgtgttaaaaaccataccgaagaagacttactctttaacaaaggtaagaattgcttttttaaatgttcaatatctgaatcaagaacatttttttcattgccaaaagatgaatcaaaaatataaaaatctatattcttactgtctaactctctagcattaaactcccatgagtctgtaaaattttgacacctatctgaagaagaggaatattgataagggtctaaatacctaaaccatcccatatatgatctatcacaattttcatgattaccccgaacaaataaaaatggagccttaccagacaataacattgatggatctaaccaatcagctttccatgtttcactattatctccataaacattaccacatctttcgacatcaatacattgaactgctctatacaaataatcaccaacatgaattaccaaatcaggattatgtgcactgatgttagataaaatcttttttaaaggccactcttctgaagacatacaatgctgctgactcaatcttgtaccccacaatgacactatacatccagtatctcctataactgctattttcctaatctttctacttataacaggaagatccacattatcaatagatatcagactagttgtttgaggcactaacaattcacaaactttatcattaaaaactcctttttgtggaaatgctctaacactcatttccaattcttgatcatctacgtttactataggacactgttcatcctctaaaacaatagctctaacactcaactgattattatttacaacctgagaccaagtaaataatggcttagcattagcaggtatagataataaaatcaaacatataaaaagatatttcattttaattggaacaaatttcacttacgcaacctcaaataatgacatagatggttgagtataaatctcacctacaataaaattaacagcttcacatttagtaaatctagtattcatgttatcagtaaagttactgcatataccacaaactgcagttaaaaacctaacagaaaaatacaaacctgccaaagatataccaaccattaatattgcactatatatatccggcaataacggtttgttaacatgtttagacaataacaaaaagacacaagtcataacacaagtagtagcaaacagtacattacttatatatctaactattgttatgccattaattctcccactatctcttgtattttgtacaaaatgggaatgatcactaccttctaatggttgtacatcatgatttttagattccacaatacaatcaataagcttaacaaaaaataacattaaaaataacattgctgatacgctgattaaacaatcagatgctacatctaggttattccctatagcatcataatgcttcaatagaagcaagattgctcctatagtatatattaacaaacaagtcatacgtatttgctctaatacactagcaagttttttgtttttaatccgtaaacacattaatatattccctgaaaaattactgaccccaaatattttttagtgtaattaataactcaaacacacaatacttcaatcacaattattacttttttactaatataacttgctaataattaactgttttgtcccataaaacatatatataccaatatttaattattctaatgctttcctttaaacaataaataagatatgctgttatttaagtttttacaacgtacttaataaatgaatactgatgatttattgttcacacccttaggcggagtcggacaaataggcatgaatgtcaatttatatcacttaaatggtaaatggataattattgatttcggagcaggatttgctgatgacaatatgccaggaatagacatgattgttgctgatattagttttatcaaaaaaaatagaaaaaacttgcttggtatagtattaacacatgctcatgaagatcacataggaggcatacaatatctgtggaacgatttgcaatgcccaatatatgcaacaaaattcacagctgccttattacaagcaaaattgaaagaatatccatttagaatcaatattacagaaatcgacatcacaaaaaaattaaatcttggcccttttactcttgagtttataaatttgacacactccataccagaaatgaatgcaattgcattacacactgaaaaaggaatagtagtacatacaggagattggaagttagatgacaacccaattattggtcctgtatcaaatacacaaagattaaaagaattaggagacgaaggggttttagcacttgtatgtgattcaacaaatatatttactaaaaataaatcaggatctgagagtgatttagaaaaaagtatatttaatataataaaaaactgtaatcaaaaagttgcagtatctttatttgcatctaatattgcacgaatctataccatagtaaacattgcaacaaaattaggtagaaaagtagcaatactgggaaaatctcttataagaattatacaagctgcacaagacagtgggtatttgcaagatataccagagttcatcaatatcaatcaagcaaataaactcccaaatgatcaagtcttgcttctttgtactggttgccaaggtgaagagctagcagcaactgccaaacttgctaataattctcatccattcactaaattagataatggagatactattatcttctcttccaagatcattccaggaaatgagaaacggatatatagtgtattcaacaaattcgttaacatgggagttaatgttattacagaatttatggaacatgtacacgtatcagggcacccttcaaaaagtgaagtatctactatgtattcattagtaaggcctaaattatccatccctgtacatggagaatacatacatatgcacgaacatgcaaaagttgcaaaacaatgcaacgtagaaaaagcgataatagttcacccaggagatgtaataagcctcacaaaaaaacaaaaaattaactctgtcaaagctggatactttggagttgatggcaatttcttacaccatcccaaaggcaatgtcatatctatgcgaaaaaagatgagagacgcagggataattataataacactagttttaaacaacaaaaaagaattattaaaagaaccaaggatttttgctccaggagtgctagatcattctaatagtcaagcaattctcaaaaaagtctcatctaaaataagtagcgagctttattctagaaaaataaacaacatacgacaatacgtagaaaatacagttttcaatgctttaaaatatgacatcaaaaacaaaccatttattgaagtacagctagaatacataaattagtacctttatcatttatacaatagaatacttatattgataatctattgtaattaaatattcctaccataacatagaacaatatctatctatataattaactacaacatgcataattagaaagctattacaacttatttactgataataactagcatttcataaaacaagatcattttttatataataattaagataatctattagctatcacaacaatttttaatataataatagtgtttattagctaataagtattgtcttagcatcataatcaatataaattctaaacttgtcacaacaattttaacgttgtatatgtacaatgtatttttttcaattaaatataatggataatcaatcatctataataaaagcaacaatagcattaataccatttcatggggtatcggatgatacactattaaaagcgtgtattgatcttaacttaagtgaagaattttgtaaatttcataacggtatatacgatgtattaaacagtataaatgagaatttgattaactttataaatacgaaatttcatgagacagaaaatataaacaatttaaaaatacgtgaaaaagtacaacatgcagtgtacctgtgcttaacatattatatgtctttaccaaattaccgagaattgttaaaaagcatattatctgcaacatcatataacatgtgtttcttttctaaatctttatataaattagtagatcacatttggtatttaattggtgatcaatcaactgactttaattattataccaaaagaactacactagctgttgtatatacaagtactattatgtattttatcaatgatttttctcataatcattctgatactattctttttttagaaagacgtattaataacgtcatacagatacataaattaaagtcatatatagctaataagacagaaaaatttaatatattcaaagtcaaatttgatgatgaataaagaaaagttatattataacagattttaccaatcaaatactgtcagcattaataatgcaactgttatattttcaatgcagcaaagtacaaaaattttactcaaaccaaatactaaaaaaatcaaatatcactattgataaaactatagttttatcaataaaattaatcacaaaccgtaactattattagtagtgtaacattatattttgctataaaaaccaaccatatctttaagcttatcaatctcaataggcagttgtaattagagaaaaatactaagataaaacaataaaaaattaatttagaaatattatacaacagataatattataaaaatcccatacactaaacataaaatattggaacaagtaaagatattttaagatatttatctgataaatagtgcattataatatttaccaaatatgctataaattaaatgttacacttattatattatacactatgtatcaaaaactcaaaaatctcataaaagtagggttttcactaccaaaacttttaggacataacacactacatctagaagatagtgaagaaaaatcaagatcaagcatactaactaaatcactgtttattatagacaacataataaactttttatttaagtacaacagaaaggattcagtaaatgaggtattgaaaatatcatggggtccgctattcactggatttatcattattttactcttttttggcatatttggaatatggtctgcagtagcaccactcgatggatcagtaattgcacaaggagaagttattccttcatcagaaaaacaaataatccaacatttagaaggtggcatcattaataagatcctagtcaaggaaggagaattagtacaaaaaaatcagcctataatatctttacataatactacagctaaagccaatctagacattataaaagaacgagtacttgatctattagcaacagaggctaggttagttgctataaaatacaattatgaatctctaatctttccagacactctaaaaaatctatcagatgaaaaaacaagaatacaaataataaaaaatcagcaacagttatttgagtcgcacaagaagaacgtatccggacaaatagatattttacaacaacgtataaaacagctacaccaagaattatccgggttatctgctcaactaacttcagcaatcactcaacataaattaattaatgaagaattagaaacaaaaaaaagcctgttagagaatggatatattagcaaaccatatattattgcacttgaacgtcaatatgctgaatccaaagggaaaataggacaaattaaatctgctattgcatcagtaaatcaaaaaattggagaaaataaattagaaataattaatattaccaacaatgtgcaaaataaaatcaatcttgaacttaaagatgtaacatctgccataacagacctaaaagaaaagatgaaaactgctcaagacatattggatagaactataataaggtctcctcaagccggcatcataacaggattaaaataccacacagaaggtggagtaatacctcctggagctcccataacaaacgttgtaccactaaatgacgatttaattatagatgcaaaaatacaaacaaggcatattgaagaaattctatctgcacaaatgaaagataaaaatatagtatcatatgagaactatcatggattaaaagcaaaagtacgcctaagtgcatataacatacgtaaaattggattagtaaatggaatagtagtacaagtatcagctgatgctttaagtgaagtcaatggaatgcgttactataaaatacaagtaataataccaaaagaacaatctgcaaagctaaaaaatttaaaattgtatcctggaatgccagcagaagtttttataattactcaatctcgcactttgtttaactatctgttcactccaataactagtacttttgaaaaagcttttaatgaaagataaaattggattagtaaatggaatagtagtacagtatcagctgatgctttaagcgaagttaattggaatacgttaccataaaatacaagtaataataccaagaaaacctgcaagctaaaaaatttaaaattgtatcctggaatgctaacagaagtttttataattactcagtctcgcactttgtttaactatgtattcactccaataactagtacttttgaaaaagcttttaatgaaagataaaattggattagtaaatggaatagtagtacagtatcagctgatgctttaagtgaagttaattggaatacgttaccataaaatacaagtaataataccaagaaaacctgcaagctaaaaaatttaaaattgtatcctggaatgctagcagaagtttttataattactcagtctcgcactttgtttaactatctgttcactccaataactagtacttttgaaaaagctttcaataaaagataaaaacaaccaaatctaagattacatagaatacaataaatgtatttcatataatgctaatctatggaacacatttaagtataattcaaaaagggaaaagcattatgaaaacaataggaaatattatttatacttatatttaatgtaaactcatagaaaatccacaaacatacaataagttacttaaaaataacttaaatgtttcaattgcgataaatagatttttgatacttataatatttagaaaatagaaattacacttttgcatatctatgataacacaaagctatataatacacattacctatacaagcttttccatacttataacaatgagcacactctacacatcactgatattagtataactacttacacaagcatcctccacaatcagaatttacatctgccagacaattatatatctaagataatattaaaccatatcacaataaaccattaaatactatttacaacatgattttatatttagacttatcatattgaaacattctacataatataactactgatatcagtccaataagcactataactagagcatatggagctgcatcagtatatctttcatcactgataagctcatacatcctggtagccatagtatcaaagttaaaaggcctaataattaatgttgctgcaagttcttttatcacatcaacaaataccaataaaaatccaactagtatactctttttaatcatcggaatatgaacattaaaacatgtagaaactatactatgccccatcaataaagacgaccaatctatttctttcggaattttatttaatccagattctataggacctaaagatacagcaagaaatctaaaaacataagcatatattaacccaaatgttgtcccaatcagagcaaatgaaaaatatgagttcacaaaatgcgatatatttccaagtaataccataacactgacagcaacaatggtattgggaatagcataacccatcacaataaattttattgcataagacaacgattccctttttctgatgatatacgacataacaattgatatcacaatagcaataacagctgttataaatgctatactaacactattgaatacagacatataaaatcgattattaagtgccaatgttcctattttttgaacagtccaatataataaaggaactacaggtattacaaatcctattaacactggcaataaacacacacaatatattagtataagtttcaacttactcttaacttgccaagtatgataatattccgtattcatctttattgttgaatacgatatacctttcccacgaaataatttttccaatatgataagcaaaaatataaaaaacaatgcaataaaagcaaataaacaagcagaatacttatcatgcaataaaaaccaatttctatatattcctctagtaaaagtatcgattgcaagaaactgtggtgtaccaaaatcagatattacttccattaatacaaatgatacactaacagcaatagctggacgtactacaggtaaagcaatagaagttaaaattttatacctagaagaacataacgtagtagcaactgcaacagtactacgaatagctattagacctgttctaactaacatatatacataaggatatagattaaatcctataataataattccccattccaaagatttaatactagggaaataataatcacctttactccaatgaaaggtctctcgtaaaaaaacctgtaaaggacctgaaaactcaaaaatatttacataaacatatgcaactatatatcctggtattgaaagcggtaaaaaaagagctatttcaaaaaatttacgtccaaaaaatgaataataagttacaaaccaagctgttgataccccaataataagtgctattattcctactcctaacatcaaaataatagtattaaaagcatattcaggtaaaacagatgttagtaaatccatcgtcttattctcagtaaatataatagaaaccaatgaaaatattggtgctataaacatgccaactaatatacagagaaaaacgttcttcgaaaggtttgcaaacgacactatatttgagaattaattactacccagtcctatgtttattatacataaacaatctttacagtcacttaaaaccttgcaaaatattttattgataaaatttccccatatgtgatatataagggcttaaatattcgactaagtattttatgattgaagaaaagataggaaaaaagtatcagtatcatgtttctctaaggataatgcattggttaactggcataccaatcatactgatgctgattatgggtttttgcttaaaaatggagatcttccctagtcattatccaataggacagctgtataccatacataaagcaatcgggatggtactattgttttttttaacattacgcataatatgcagatttaattcaattactccatcttatcctaaaagcttctcatatttcttgacggtagtatctaaaattacacatacaagcttatatattaccgctataggaatggccacttctggctatgtcatgtcttcagcttcaggaagagcaataaaaatcttttcatgtaatattccactattaattgatactaataaacatatagctaatgtcgctcagcaatgccacaatatatgtgcgtatatattgtccgctttaataattgtgcatatattagcagcactaaagcacaagtttatagataaagataatgtttttaatcgtataatataatcagagtcgtcatgctatcagaattatggaaagtaggcatagagtttttaggaagtaaatttgccattatgggtggagcaatgagttgggtctcagatccttacttagtatctgcaatatcaaatgccggaggtttcggtgttttagcatgcggttctattagtccagaagaattaagaaaagaaatagaacttactcaacaattaacaaacaatgcgtttggagtaaatctaattataatgcaccctattcttaatgaattaatcgaggtatgcattgaaaaaaacattacacacatagtattagctggtggtatacctaatagtaaaattataagccatattaaaaatgcaaaaattaaagtgatgtgctttgcatcatctttgtcaattgcaaaaagattagtaagaataggagtagacgcattaatagtagaggggatggaagcaggtggacacataggccctgtaagtacctctgtacttgcacaagaaatattaccctactttaggcaagaagaatctcttaaaaaagtacccatttttattgctggaggcattggaaggggtgaaatgatagcacactatctaataatgggagccagtggatgtcaaattggcacgctttttgtatgcacacatgaatcacgtgtacacaaaaactttaaggaaatctttattaaatcctcttctagagatgcaatatcatcttcacaattgagcaaagatttttcagtgataccagtaagagctatagaaaatgatgctagcatgaagtttttagaactacaaaaagacgtaatcagtttataccatcaaggaaaaatttcaaaagaagatggtcaacttactatagaaaaattttgggctggagcattacgcaaagcggtaatagatggagatattactaatgggtctcttatggctggacaaagtgtaggtatggtacatgaaatacaaactactgaacaggtaatccaaagtcttatactacaagcctgcaattatataacttcagtacaaaaaattaaccaacatcaaactattgcatgtacataagtaaataatgtcacacttcatataacctgatacaagatcataaatttactgagttaagtaccaaataagcttctttctagagagtttacttcatactatttcataatttctcacataaaaagcatagcaggaaatctcatgtaaacgtgaaatactatattcttttttaaataccaatacaattgaatacaaaaaaacttttacaacttattatgtttatcttaaaaccttattttaagattccttatgtcacaaaataacaaaaatactatttacaaaatacaccacaatttcatcaaataaaaaaaactatacactttattatactacagtagatataccataaaagattttaagtaacttgacataatattaccttggtatagcatatgattcagtattttatattaaaatttattatgtattggagcataaaatgaaagttatcaaatttatacttaatatctgtttattatttgcagcaatttttctaggatattcctacgtaacaaaacaaggcatttttcaagtaagagatcataacactcccaatacaaatatatcaaataaagccagcattactactagtttttcgttagtaaatcaagatggaaatacagtaaatagtcaagattttttgggaaaatacatgctagttttatttggattttcttcatgtaaaagcatctgccctgctgaattaggaatagcatctgaagttctctcacagcttggtaatgacacagacaagttacaagtaattttcattacaattgatccaacaaatgatactgtacaaaaattaaaaacatttcatgaacattttgatcctagaattcaaatgctaacaggcagtgcagaagatattgaaaaaataataaaaaattacaaaatatatgttggacaagcagataaagataatcaaattgatcactctgccataatgtacattatcgataaaaaaggagaatacatttcacacttttctccagatttaaaatcaacagaaaatcaagtagataagttactatctataataaaacaatatctctaatttaataattaattaaagagaatagtacacactcttatataaattcatggatatatgtgatgggtagatttcttttggtgtttctatcgctaattacattagcatttaattccagcgcacaacaaatacgagttgttggatcatctacagcattcccatttatttcagctatagcagaagaatttggaagattttcagattacggcacccctattatagaatcagtaggtagcggaatgggattcagcatgttttgtcaaggtgtagggaaaaatactccagatatagtaatgtcatcaagaaaaattaaggatgcagaagttaaattatgtcaaagtaataatattaacaatattatagagatcattataggttatgatggcatagttatagcaaattccaaagatagtgccaaacttgattttacaaaaaaagacctattcaaagctttaagtaaatactccacatcaaatgagtatgttgaaacaataccgtccaacaacttcagatattggtctgaaatcaataatagattccctaatattgatattgagatctatggaccatataaaaatactggaacctataacatactagtagaagagatcatgcaagatgcttgtatgaataaccaaaattttatcgatgtatactcagatcctacaaaaaggcgtcgtatatgtagtattatgcgtaacgatggcaaatacattgaagttgctgccaacgaaaacattattatacaaaaaatagcaaaaaatcaagacgcttttggcatattaagttttagtttcttagtaaaaaatcaagataaaatacatgcaaataaaatagcaggtatagaacctaattatgaaactatatcttcaggaaaatacattctgtcaagacccatatacctatatataaaacaagaacacatcagtttttctcccagcttgaaagaatttattaaggtaattctaagagaagattccatcggcaagaacggatacttaattgggctaggttttatacctttatcagataaagacttacaagacactaaaaatcgtattaccggtatattagaaaaataatagcacatatcataaacataaccttatttataataatatatacttttagtatttttataatcataatttcttaaaaagaatttgacataattaatttgttgttggtatcattattgctcgatttatctatataggaggactttctttggttgaagttatagtttaccatggagatatagaacaaggtatacgtacccttaaaaagaagttacaacgtgagggaaaacctaggcagatgaaaattactcaccatgagaaaccatcagaaaaacgtgcaagaaaaaaggatgattgtgaaagaagaagaaaaaaattgcacaaggtgccttacgaaccgcagtttactaagtttcaagttagtgctagacattttcaggtgaagaggccttctcaagctgataatagcactagtgaatgagcataaatttatactatagctcatctatatttttaatcagtagtcagagttcaagtaaggtgtattaatatgaatattcatgagtatcaggcaaagcatatactgagcaagtttggtgtaaacgttccgaaaggggttgtagtacattcattaggcgaagttgatggtgctctcagtcagttaaattcaaaggtagtcgttgtaaaagctcaaatccatgctggtggtagaggaaaagctggaggagttgtagtatctcgtacattagatgaaaccaaaacgtctataaagaatatgttaggatcaactctgattactcatcagacctcaaaagatggacagaaagtaagaaaagtatatttagaagaaggatgcaacatcaagaaagaatattatataagtgccattgtaaatcgtaaacaaggtcaggtaagtataatattttcaactgaaggtggtgttgacatagaagaagtagctgcaacttctccagaaaaagttattgtatgcaacatcaacccagtatttggattccaaggttttcatggacgcaatttatgctttgacagtaatttaagtttagatcaaacaagaaaaatttctgatatagctgggaaaatatataaagctgtgttaagcactgatgctaaccagatagaaattaatcctctagtagaaacatcatcaggggaattcattgctcttgatgcaaaaataaacttcgatgacaatgcactatatcgtcatcctgatattcaagaattacgtgactatgatgaagagatcaaagaagaaatagaagcttcaaaacatggtttaagctatataaagatggatggtaatattggatgtatggtaaatggtgcaggccttgctatggcaactatggacattataaaatattacggtgctgaacctgcaaatttcttagatgtaggtggaggagcaagtcaaaaaactgttactgaagcattcaagattattcttgcagatgataaggttaatgggatactagttaacatatttggtggtataatgcgttgtgatataattgccaacggtattattgctgccatacaagaaattggtataaatgttccactagttgtaaggttatctggaacaaattttgaattaggaaaaaagttactagatgattcaaatctaaatattattacagcaaacgatttaagtgaagcagcatacaatatagttaatatagtaagaaaatagaggcgatatgtccgttttagtaaatagcaacacaaaagttatatgccagggatttactggtgctcatggtacatttcattcagaacaagctattgcttatggaacaaacatggtaggtggagtaactcctggaaaaggtggaacatatcatctaaacctaccagtgtttaatactgtaaagcaagccaaactagaggcaaaagctaatgctactgttatttatgttccagctccttacgcagcagatgcaatactagaagcaattgaagctgagatagaacttattgtttgcattacagaaggtatacctaccctagatatggtacaggtaaaacatgctttactcaactcatcaagtacattaataggaccaaactgtcctggaattatcaccccagaagaatgcaaaattggtattatgcctggatatatacataaacgtggtcacataggtattgtttcacgttctggaacactcacatatgaagcagtagcacaaaccacagaagtggggttaggacaatcaacatgtattggtataggtggagatcctatccatggaatgtcttttacagattgcattagactatttataaatgatccagatacacatggtattatcatgattggagagattggaggatcagaagaagaagaagctgcagaatttatcaaattatcaggaactaacaaacctgtagttggcttcatcgctggcaagactgcacccccaggaaaacgtatgggacacgctggagcgatttcttcaggtacctcaggtagtgctgaaagcaaaatagaagctatgaaaaatgcaggtattattattgctgaaactccagcagtcataggcaaaacaatgttagaagctatgaataataaacgctaaacactttaactaatgattgattagttcatattttttaggggctactttcacattaatgttgtttgtgttctacattttagcactttaatatcaacacattgttttcatacttttatgccattttaaaactacaatgaggtttctacacttacaatcatcggtttatatacacttacccaccacgaaaattatagacacattatcacatagataacactgctttcacattaatgttgtttgtgtctacattttagcattttaatatcaacatattgtttcatacctttgtgtcatcctaaagctataatgaggttttacacttcataatcatcgtttatatacgctgaccatcatagaacactatagacacatacttcgtataaataactaagttataaatccattcctacatcatagaaaacgttacaaatatttatatgcaagtacggcactatatttactgtatttgaatctgaatatttaaagttctacaaatctgcttataaaactgagttataaaaacatattaaaaatttgtattacttaattactaagaatatcaaccaatttactctttacattagacataatatctatctccttaacatattctccattaatttgagctaattgagcatttcctccacctttactttttaccattgtacctatcatttttacaaaatctacagccttaactttacaatgcaagctattgccaactcctacaacacacacaacattttggcccacaacattagcaaacaatataattctatctgcagtaagatgcttattaataaattttctcatcacattaacaggtatgttactcaaattgctgtataagaaatcgacattccctattttttcagtattaacaccttgtagattaatcatatcaaaataaacatcagacaatttttgttctagttcctgatttttcttatcaagcttatctatttgtaccaatacattatctacaggaaccttaacactttcagcgattgaatttaacattttctcttgttgcctaaaataatctattgcatatcgacctgtaacagcttctattctacgtattccacaagcaatactagcttctgatactattttgaaacaccctatctcactagtatattttacatgagtaccacaacataattcttttgaatcttttatactaactactcgaactccatgttcttcatatttttcagtaaataacgcaacagctcctccggcaactgcatcttttaagtcacatacatgactaataacaggattatttccagatattaaagaatacattttatcttcaattaaagtaagctgttcttttgtcaatgccacaccataactaaaatcaaaccttaacttttcatcacttaccaatgatcctttttgcatgatactactatctatttccgattttaaaacgtaatgtaataaatgtgttgctgaatgattagcacataaatttcttctcctttcacaatcaatttttgcaaaaattacatcccctaccattaaggatccttgtttgataatgcattcatgaatataaagggtatctaatacctttttcgtatctattacttcagcaatattatcattagcaaataattctttttcttgtctaacaattacattgaatattcccacatctcctttctgtcctccagattcagcataaaacggtgttatatccaataatatagaaactttatctccaacattagctatttcaacatttttatcacctccacaaactattgataaaactgtagccttagtatcataacgctcataccccacaaactttgtactaccacaacgctctttaatatctacccagaattcctcttttaactgctgatcagatttgatagaatgattaagtttagacctttccttttgtttattcatattatcataaaagccctgctcatcaaattttactcctttttcttttatgatatccaaagtaatatctactggaaatccataagtatcatacaacttaaaaacaatatcacccgataaaatatcacctgaagataaattcattaattctttttcaagcaatggcaatgctctgactaaagtatctttaaaattctcttcctctatctttaaaattgacattatcaaatccttagcatgaattaattcaggataatagtctgccatatatccacaactttcttcatcaattaaagtcgggaagactttatacattaaagcatcatcatattttaacatatacacataacgagctgctcttctaattatacgacgtaaaatataatttcttccttcattacctggtgttaagccctctgctattagaaatgctgctgatcgcacatgatctgcaattactctatgagcaagttcatttgtactattacctgattgctcttttgatgctgctatcaaagctttaaataaacttatatcataattatcatgtactccttgcattacagctgcaatcctttcaagccccataccagtatctatacattttttaggtaatacacataattcaccatctaactttctatcatattgcataaaaactaaattccagatctccgtaaaccttgcaccatcttcttctggagtacctggtaatccaccttttacattatctccataatcatagaaaatttctgaacaaggaccacatggccctgtatttcccatactccagaaattatcactagttgttattttaattattctactgtcagaaacgccactgatctttttccacaaatcaaatgcttcttgatcatcatgatatactgtaaagtatagcctatctttgctcaaagaaagttcttttattacaaaattccaagcaaattctatagcaccctctttaaagtaactaccaaaactaaaattaccaagcatctcaaaaaaagtatgatgtctatttgtatatcctacattctctaaatcattatgcttaccacctacccttaagcatttttgacttgatgtagctgtatttacattcgcattattcgggttagtaaacatctgtttaaattgtaccataccagcattagtaaataacaaagatgggtcatcttttagtattagtggagaagatggaaaaacttggtgaccattttttgcaaaaaaatctataaatgattttctaagattgctaactaaattatttttcatcatatattaatcatcataaaatataagctatataacaaaagtatacatttgatattacaaagcactataaaagtgataaaataaattgacttatacagcaaaggtataattattaatctatacatataaaaaatttgtgaactttatttataaataccatgatacttactataatactattgtccattacattactaataggaaattatcataaagtaaaacttactttcgaagataaatttaatatcataacttccctaaatatcatatacccattcattatctgttattcgttttatactcaacatctaaatataatatttatcctaataacatttattatattaattctaatattaatagcagcatacatagataaagaattcatactccttaaacttatcatgttttcctcagtaggtatactttctcttattgtaatatgtatagtattatgcttaacctacgaatcagcactatttttcagcaaaatatcattgattgactttctgtttggaactaactggcaacccagtccagacattttagatggaaaaccagttggatcattcggaatattaccactactcagcggtacactacttatagttattgttgcaataaccatagctgtacctttaggattactatctgcaatttatattagtgaatatgcaagcaaaaaaataagatacatagctaatacaacacttgaaatattagcaggtattcctacagtagtatatggatactttgctgtagtatttttatcaccatcaatcagaagtgtagcaaaatattataaccttaacgctcaatcagaaaatgcattagtagctggactagtcataggaatcatgatcttaccattcattacctctctcatagaaaatgctatacactccgttccaaagattctgcgttatgggtctatggcacttggagcatcaagagcagataccatatggaatattataattccatatgcattaccaaatattattagttcaattatattatcaatttcaagagtcattggagaaacaatgatagtgttaatggcagccggcataactgcacatttaagttttaatccattacatgctgtaactacaatcacagtacaaattgcaacaattttaactggagatcaaaacttcaacagtattcaaacttcatctgcatatgctttaggtctcacattgtttatcataacatggcttcttaatttactagcactacacattacaaaaaaagcaacaaaatctattaaaattcactaattccatatgttaaactatacactagactatctcagtaccaaacttaacattattcccttaatagggatagaattagaattttactttgataatatagacccaaataatatcagcccattaattagcaacattcaagacaaaatatcttctcttaactgtaatataacaaaagaacaagataatctacaatatgaaatacaaacatcaacaactactaacattcctaattttattattgagcttgatcttataaaagaaattttagaaaacaacacaaaacactttggagggagcattaatttctctgcaaaaccatatttagataaaccaggaagtgcatttcacatacatataaatttacttgattttcataataataatttgtttactagccaaaataacaaaatgagtgaccatctatcctacagcatagggggattatgctctttaatgaaaaaacatatgattttttttgctccaaataacaactcctacttaagatatatatatgctgacatagacaccccaacaactataagttggggaggaaataataggagtacttctatccgtataccaagtaccagtacagacccaacaaaatgcagaatagaacacagagtacctggagcagactgtaactataaacaagctataacatcagttctgcaaggaataatttatggaatagagaaaaaaatacagccaccacaaaaaatttatggtatatcctcagacatacaatataatcttgaaaaattaccattgagtttaaacgaatcaataaaatataacctaaagtagagaacttacaataaattgttattacaaatagactataaattaattttaccaaaaatagtttatgtaatagagaaaaaacaccacaaaaaatttacagaatatttttaacatataacacaacacataaaaaaaccaccattgaagtaaaatactctattgaatcacagttagcctctacaactttagctacacagcaccttaaacacagctaagtttctattcttatgatgttcacacagaactacgtacccctgttatgtgtctcacatttctctattttataataactacacattaagttgtaggccatcataaccaaccactatattatcttgagaacgacttcttatataatcaattaaagaatagtactctagatcatgactcatatgagttaaaatagcaacttctggtttgaactcttttatccaatctaagcataaatccacatgagaatgtgcaaaacttgcagtatacttcaagcaacctaatattaatacctttttcttatataaaaatttacaagattcttctgggaaagattggacatcagtgcaataagcaacctgatcattaaatataaatccattagaattactaacaccatgtaactgctttatagctaatatacaaaaatctccaatagtgaattctttataatgatatattgtatttactgttaaataatgacatttcttccaagcagaagtatatgcactaggaataaaaaaatacgaattactagcagtcaataaacataaagtatttatatcactatatataggtatgctattcaaaccgtgcttaggaagaaatggttgaagatcagcaataccatcacaatgatctgcatgaaaatgagtatataatactgcatcaacagacgataaattatttttcaatgcttgacatcttaaatcaggagtagtatcaacaagcagctgtgtatctccattttcaacaaatattgatgacctcattcgcttgttgtatgttaaatttgaactacaaacatcacactgacagcctactattggtactccaccagaagcaccacatccaagaattgttatcttcataaaaaatcaacatactcatacacgatcaatatcattagcaatttcattagtcaagtatataaataacattaagcatataaactagggctatagcaaactaaatgtaccattagaacacttataatatatttaacttactataaaaacataacaaactattgcataatcaaacataccagtacatctgcaaatgagatacttaagttactgtcacagattgaaacgtttcataccagtttattataaacattaagtatataaactagggctatagcaaactaaatgtaccattagaacacttataatatattcaacttactataacaaaaacataacaaactattgcataatcaaacataccagtacatctggaaatgagatacttaagttactgtcacaaattgaaacgtttcaataccagtttattatatgtatcaaatatcttatttttcaaacaagttcagattataattatttatcccatacataaaaaataacttattttaaatttttacagctattactattcgacaagtgctttacgtccttttaaattggatgcctatatacacattttcaactttattgcatactacgactttgagcatatatagtatgtagtttcataatatcctcgtctgaaaaaaatatactcttaatcttactaatattaaaatttcttctttttaactctgcagcacgttttatttcttgcacattttgttcagtaacttcttcattttctggtattaaactttcctggatcacagaataaaagttacacacatcaaacaacatgtcctcaattttactagtattaatattcaaattacttgtgatcacccttactaaatactcagacattacttttaatttttcttttggtacataacacaatgtaagtcctgaatcatctttctctactaatttacaactattatttcttaatccaaaaattgtatattgtaccttattattaaaaaaatccatctcacaagtataacttgtacaatgatgcaatgcatatactaaaccaagacaatcacgctgactagcctgacatcgaataccaaacattgtacacaaaaatatcattgacaataatattatactagctttcatcaacaaacctacctactatattatacaactcaaataaaatggtaccacgtataacaggtacagtttcaccttttaatacagcttgcaatacttcatttgtaatatccgtatttttttcaacattaagctgagtagcctgatattgaatactaaacattgtacataaaatcatcattgacaatagtattatactaactttcatcaacaaacctacctactatattatacaactcaaataaaatggtagcgcgtataacaggtacagtttcaccttttaatgcagcttgtaagacttcatttgtaatatctgtatttttttcaatattaaaattaacaacttttacatacccagaaatatcgtgacgtatcgtattaagaaataagaatacctgctcatcactaatagatgaaaacttaatctcaatattacgcttaattatatctatatgctggttatgatatatgttattaactattttcggactagatatgtttatctgagaattaaaaatataatacttcttaaacaaactgcttattagcgttcctaaatcttcctcataaaaagtactatatatatttgaagttgatatttcttgccataaaactccactatcatttagcatagcttcatgtttgtgaacgtccatgattttgaaacttaatttttgaatttcatcagcaatacgcaaattatgctgcactatataagtattaaatttatataaataatgtaatgtcatagataaaacaaccaacaatatcacacatacagatatcttggttatgcaatatcttcttaacaattttttgttcattacattacttctccagttttatcacaacaattctttgactatccaaaacattaggagcagtatctattacttccactttataatctccaaactcctctattattctatcttttaagctgttaaaataatatgaaaattgcttttcctctacaaatttcagtaacaactttactgctacaccatgactattcgtactaaatgacaagtaattgattttaaaacctttcaaatctatttttcgtaaacgtaaaatcaagtcaaaagaaaaaaaatcatctgctaaaagaagtttatatacatctattgtttcatacatttcactaacttgctttacttgagtatcttgattaattttctcaactcgagatactaattcctccttacgaagtagtaaattaatgctctcatcataattattatttatattaaatatataagtaacattcaacaaagacatcaatgcaataaaacataataaagaaggtataaaatacttattaaagaaggaaatcttacaaaataaactagtactcctcgtatgaaagatttttaacggttttttttctgtcatggcacataacactacagtatcacaaaattcactcatgacatttgaagattgctttaacatcaaaatttttgacaattcatacggtgtaaaaatattcgcatctatattcttaaaatcaaataacaacaaactagtttttatattactagaagttataacatacaaatcaattgtcgattctttactatatccaaatttcgtaagatataaaattgtatcagatatttcctgataaactttacctgcaataatacttggcaatacttcatctgcagctacaataatattactcacatgtatcattttgcctttatacaaaacgatttgtctaaaatcatttgttttagtataaactattaatatagtccattctccatcacccttaccttgaagttttagcaatttctcacaaagatatgacaactctattggtaataataatattccacaaaagttacacaaattatcagtaataatttccaacagtttcttagataaactgtttagttgacttgttacaaccatgtaatgccagtttttatctgaagtatctggttttgttaacaaaaatgcagaacctacatcacaatcactcataatgttactaagattcattttgactaaagacctagcaataattccactatatgtaggcattacatgttcagtataaatttgatcagaatgatttaatacaaggtatacttgagatttcttatacttaaccatacatgatataactttcgataaattcatatcctgttcgttttcaataaaatacttatcccgtatttcaccattaatgatattaagcactacagacccattatccccgacagatataatgattctatttttagacattttagaaaaaaatgacattatctttacacaaaatttatagtatttacgctagcttttataactaatataaagaagcatctcatttttactatcaactgtaataaataaagatatattaataaaaatgcgaaagaaatataactagatctttgaattaatactatttttacatgctacaacaaaaagaatgtaatctaatctactacaactggaatattttatataatcatacatactttttataatgcaagccatattcttgaagcatcttaataaaactttagttacagctttctatcactatattcctaatgattttttctcaaaaatcttatgaaaatatacaaagcaatagcacaaacactactactagaattaagtttatcacacacaattttataaaatacttactaaatatttacattgatcatattttttataatgcaagctatattcttgaagcatcttaataaaactttagttacagctttctatcactatattcctgatgattttttctcaaaaatcttatgaaaaatataaaaagcaacagcacaaacattactactataattaagtctactatacacagttttataaaatacttactgaatgtttacattggtcatatattgcttctttattttaacacaagcataatacagttatatgacttttactataacttcccaaacacctaaaatttctgttaatttaaatacttctaaccactttatttgacctataaacatcatattaataaataattttcatatgccatcctgttaaaagctcgaatttcatggaattgctacgttttttattaaacatttctagttctttttattttgactaataagaattatatttttcataagcgatttccatatgctgatctactcgagattcgaactcctgcaatctcttgtctattactcaattcaaacacttgcaattcacgaacatcatgagtcccagatctcctattattcatatacattgtaaaattccgcctcaatctattacaaccagatctattgtaaaatatccctacaaaaagtataacaaaaagcactacaataaatattgctccaactaataacccattattctgaaaactatgatctacagagtataccttactcctgctaatattattatttgtcaataaaaagctgtctaacctactcacattagcagttgtaatattcaacctatctgttacagcataatcactagttgtttcaagatcttcatcataaaacacatgttttcttatagtactttttcttttagcactagattgagtagtgctttttacattatactttgcccttttgcccaatatactatattcaacatctgaagcattacttatatgttttttccctgatgtaaattttgttctcttaactgttgtaaaatgcattggaatttttgtaacattcatgatatcacgacgagtatcagttggaatcgacgtgttacctacaaaatttgttacattctctatagaattttcagcacgattagtactcagaactgctgattgtgtagtactagatatcatagggaaatcatataatgtagaatttatttcagtgcttttctcaaacagattatgagtagtcatataagtagaagtagtagtttcatatacagatgtactattaacactagaaacacgattttgcacagcagcaaaaacatctttagattgtatttctcgaatattgaaaaacatatacatagcataattattatatgtcttcttagcttcgacccctctgatctcagcatgcatactttcaagcgatatatcttgaataacaacatttgtaaaatcaacaatatttgtaatttcatgacgcgagaattgcataacattaacatacgtaatgtttccacttctcagttgtaactctggtatctcatacctgactatattatctgcacctacagctgttaccactatattatttctaatataccttacatataatgatgtaacatgctctttaatctgcataaaatcatatatggaaagctgattacctgctttactatgaacaacaattaattgatcactatctttgaacttactgttaggtactatcccaacataagctatataggtattttcctcattacgaatagcagcaattacattaatcccacttactggaatatgatacttaacatcatctggcacattacatccataacgacggtttactacgcactcttctatatttaaattcagagtataatcaactgagatttcatatatactagaaaaaaacttgtgattgctgttaagatattttcctacataaagtaaatttaggaattttttagattccgacaccataattaatttgtcactatatttgccatatcctatataaccagaatatttaaacaaatacttggtattaaatttggcttctctagtaacaggtttaataagttgaaatttattatcacgatattgtatacgccacattacataaaatctatctggtaatttcgctctagcatcattatctactctcccaacaataacaatactatctacctgactttgatataagataacaggatatttaacttcttcttttagagaatcaatggaactacttaaacgtattttccccatatcaaacaatgttataggagaataatgtatcctatatatttttaatgatagcgtactttttagcttatactctctaagcactccttcagaaagtactacaattaaaaaatcattacctaaaccttttacaagtaacatttctggtaaataatgttctatagtacgatctagtacagcattatcattaaccttaacacggtaggtagagttaccatggctaatttcacatattagatcacttactacaactccacgttttacatagtatgcagaaaaaacagtatcatttttccgaatgaaattaatgctatacgcattcaaaatactaatctcattccgaatcacctcttgattataggatatttccgtagccgatactattggtttctgtaaatttctcataaatgaacacaaaaattaatgatatttaataatattataaatatttaataaatcaataattttagttaatttttttataaatataaacaatacgatatcaattaaaaaaatcaagattcattaatagatacaacctcgtaacctttcaaaatgttaaacttgcaaatatcttaactccctactatcattacttactcttatctaaaaaaacaaaagcatgactaaacatgaatttcttataattggaagcggtccaggaggatatatagcagctataagagctgcacaactaggatacgatgttgcaataattgaaaaagaaaatacattaggtggaatctgtttaaattggggatgtatcccaacaaaatcactactacaatctgcatcagtttaccataacatcaagaaagcaggtatttttgggattacagtacaagacataaaatttgattttaataagataatagagcgttcacgtgatgttgttacaaaactatcaaacggcattagtggattaatgaaaaaaaataacataaaagtttactatggtactgcaaaactactaggtaatagcacagtagaaattacagatcactcaaacaaaataattaatgttacatcaactcacatcattcttgcaacaggatctaaagccagaaatataccaggtatagattttgataataaaatagtttggaatgcgaaaaatgctatgacaccagataaattccctaaatctttattgatcataggtagcggagccatagggatagaatttgcgagcttttataatacttttggtactgaagttacaatagtagaattaaaggacaatatacttccacttgaagatcatgaaatatccgaatgtatgcataatattttaagtaataaaggaatcaaaattcatacaaaaagttcagtaacaaaattagaaaaattcaacaattacgctaaaattcagatctcagatacaatacatttacaagtagataaaattatattagcagcaggagtacaacccaactctaatgatattggtcttgaaaacacacaaattaaaacagatgctgcaggattcattattactgaccagtactgctgtacaaatgaactaggagtatatgctataggagatgttgctggagctccatgcttagctcataaagcaagccatgaagcagttctatgtgtagaaaatattgctgaaaaagaaaacaaaacaacaaataaaacacatcctataaataaaaataatatacctagttgcatattctcaataccacaaatagctagtgttgggttaactgaaaatcaagcaagaactcaaggttatgatataaaagttggaaaatttaatgcaaactgcaatggaaaagcagtagctatagatgaaacggaaggttttgttaaagttatcatagataaatctactggagagttattaggtgcacatatgataggagcagaagttacagaaatgattcatggatatgtcaccggaaaacaaatagaagctactgatcaggacataatgtcatctatcttccctcatccaacactatcagaaatgatacatgaggcagtactatcatcaaacaacggttcacttaacagctagtttatgttttctttaatactcgattaccgtattatttattacaagtacgtcaagctaagttgttttacttaataaaaatacatatttttccctgcaattttatataatcctataaagttagtcaagattattgacacactaaacaaaccccgcagtaaaaacacaaatacacctagccaggaatatataatataattgctacctcatttgaacagcaatgtatcccatatcaaaaacataagtacagtttggtatctcttttgtcataaacacaattaactctgaactattttcttgtaataattaagcagtgactatacatcataggtttcacaattaagcaatctacaaaaacacaagtcacaaatatagaatcaaagggatttctcttaaaataccactaattatacaatattcatttttgtattaaatagctacatatagttctacagttataagtatttcgcttatacattcattataaagttcttattttctatacccatattaactattcatcatatcaaagaactcattattatctttgcttagtaacaatcgtaggtttcacaattaagcaatctacaaaaacacaagtcacaaatatagaatcaaaaggatttctctcaaaataccattaattacacaatattcatttttgtattaaacagctacatatagttctatagttataagtactaccacttatacattcattataaagttcttattttctatacccatattaactattcatcatatcaaagaattcattattgtctttggttatcaacaatttatcccttaaaaattccattgcttcaacagatcccatcgatgacaatagccttcttaataaccatactttcttcaaacacacactatctatcaacatatcttctttccttgtaccagattttgaaatatctattgctggatatactcttttatcagatatttttctatctaatattatttcacaatttcctgtacctttaaattcttcaaatatcacttcatccatttttgaccctgtttcaatcagtgccgttgctattattgtcaatgatcctccattctctatatttcttgccgctccaaaaaatctttttggtctttgtaaagcattagaatctactccaccagttaatacttttcctgatgacggtattactgaattatatgctcttgctaatcttgtaattgaatcaagtaatatcactacattctttttatgttctaccattctttttgctttttctattacaatttctgcaagttgtacatgtctatatccaggttcatcaaatgtagaacttactacctctcctttcacagatctacacatatctgtcacttcttctggtctttcacctataagtaaaactatcaattctatatctggatgatttacagatattgaatgtgctatttgttgtaatattattgtttttcctgctcttggtggagcaactatcagcgctctttgtcctttacctaatggagcaactatatctattactctcatgcttatatcttttttactcacgctgataggatcattacattctaataatattctttcttctggatacaaaggtattaaatcatcaaagtgtacatatctttgtaactttgccatatctgtaaagtttatactatgtgcttttactaacgtaaaatacctttctttctcacttggcgctcttatttcaccacttactatatcacctgttcttaaattaaacttttttatttgtcctgcagaaatatatacatcatcaccacttgcagcataatttgcttcaggagaccttaagaatccaaaaccatcagataatatctctactacccctcctcctattgctgcacctccatcacttactacttttttcattaagtgaaatattatttcttgtttcagcattctaccattactaaccactccaaggtcttctgctattttcaacaaatcttctattgtcttcttttttagctcactcagatctaacacttttacttcttgttgttctggtactttctcttcttctttctcttctattatttcctcttgtacctctactacttctttctcttcttctttctctaatacaatatcttctgattctgacataaaaactctctctatctaaaattaagccaggttactaatgctcaagtactttttatataagctctgtggataaacacatcctcaacgttataaatacagtacttgaaaaattgatcagtaatggcaaactttctactccaagtatttacttagtaaaccttgtgtatatggcgacacatttgctaaattagcatacttttttattttgacaacatataaattatttaatcgcaacaacccttaatcttatatgcaccataactaattaaatggcatatcacacaatgtcctacaaataaagtcaaactgacaacaccatagacattaactaatcaacactacacaataacatcataacctacgtgagtacatagatctacaacatattatgaaaagcattaaaaaatatacgaaccaacaataagtagtccaataaatgttacgttattgtaatacagagtcaagacttaacttttattatacacaacatctaaaaactaacaacacattttcaacctaaaattatatatgtactttgagacagaaaatacattaattgaaattactatttgtcagaagattattattctgctagactgcatggcttgttaagaaatttaataaagtagtttatcaatgactgtttaatacatattatgatagatttccatctgtattatagagaaggcttgatatactatcagtgaatgtcatacttaatatgtttagtgttcaaatttagtactgaaagattgtattaacagtaacataaaaccatgatcaagtatttaacaatttacatttacttctcaagtggtatagataaagccatatatgtttaaaaaagttgccgtatatttaagttataagcaggagtttaaataatggaacacaaagacaacagtacaatgtatggaaccactattttatgcattcgtagaggcaataaagttataattgcaggagatgggcaagtatcgttaggacacactgtaataaaaaattcagcaaaaaaaataaaacgtttagccaatgatacagtaattacagggtttgcgggtgcaacagcagatgcctttaccctttttgaaagattagaaagtaaattagagaagcaccctggacaattactccgtgcatgcgtagaattagcaaaagattggagaatggataggtatttgcgtagactagaagcaatgatgattgtagcagataaatcagtatctttaataatatcaggcaacggagatgtattagaaccagaaaatggaatcgcagctattggatcaggaggtaactatgctttagcagcagcaaaagccctatgtgaatctaatgatcagttttctcaaaacatgactttggaatatataattaccactgcaatgaaaatagcttctgaaatatgtatttatacaaacaacaatattattatggaaaaaatagaggattaaaatgtttgttacaccaaataataaactcaaattgaataatgatacaacaaataatataaatgatgaacaagctagtagtgaagtactaaatagtgaaaacgctattagcacagaaggatatgaagatgacataaatctagatgacttatacaacccacaagaattaactcctcagcaaattacacaggaactagataggtttattataggacaagcagacgcaaaacgtgctgtagccattgccttaagaaatcgctggcgtcgtaacagggtacctgaaccattaagagaagagattatccctaaaaacatcctaatgataggacatacaggtattggtaaaacagaaatagctcgcaggttagcaaaacttgcaaaagcacctttcataaaagttgaagctacaaaatttactgaaataggatatgtagggagagatgtagactctattatacgtgacttagttgatgtagcaatcaatcttgaaaaagaaaaaagtcgtaaatttgtagagacaaaagcaaaatctttagcagaaaatataattcttgaagcactggtaggagctgatgcaagtcaagagacaaaaactatttttcaagaaaagctaagaaatggtgaatttgaaaattttgagatctccatatccataaaggaaagtaaaaatgcaatcccttctattgatattccaaatattccaggaaatcaagttggcattatgaatatcaatgagattgtacataaaatgctaggaaataacaaacaacttaagactataaaagttactgtaaaagaggcaagagaactgctaattaatgaagaaagcgaaaaattaatggatgaagataaaatcatcaaagacgctcttttgttagcaagtaacgacggcatcgtatttctagatgaaatagacaaaattgcagctcgtacagaaatcagaggagaagtgaacagagaaggtgtacaaagagatcttttaccattacttgaaggaacaagtgtaacaacaaagtatggtactattacaaccgatcacattttattcatagcatctggagcatttcacttggctaaaccttctgacttattacctgagttacaaggacgtcttcctatacgagtagaactgaaaccgcttagtaaagatgatttagtacgaattttaaccgaaccagaatcaagcttattaaagcaatactgcgcattaatgaaaacagaaaatattactattgactttactgatgagggagtatctactatagctgaaatagcatctacagttaacagagaggtagaaaatattggagctcgtagattacataccattttagaaaagctaatggaagatatcagttatactgcaacagaaaatagtggtaggacatatgtgatagatagcgaatatgtaaagaaaaagctagaagacattgcaaaacaattagatttatcaaaatttatattatagttatgcatgaaagatcaaagtttgttaatcaagtttttacttcagtagcctcacgctacgatttaatgaatgacataatgagctttggtcttcacaggctatggaaagataaagtgattcagaatattactaagggtagcttacttgatgttgcatgcggtactggagacatagctataaaagtagcaaaaaatacacaagatgtagacataacagtatgtgatattaatccaaaaatgctaaattatggacgagataatgctgttaatgcgaatgtattaaatcttaaatgggtatgtagtaatgcagagcagcttccatttctagatgacagttttgactattatacaatttctttcggtatacgtaatgttttacatagacagcttgcattaaatgaagcatatagagtcttaaaacaaggaggaaaattcatatgcttagaattctctccattaaaagaaagtcaccctctttacaaactgtataacttttattcatttaatattatccctcacgtaggacaagtagtagcaaaggatagagcttcataccaatacttagtagacagtataagtgaattcccttaccaagaagattttgctcaagaaatcaaaaattctaattttgttcaaataaaatataataatttatgttttggcatagttacgttatatactgcttggaaaatataactaaccttatatataaaagttcttcccttacagaataataccatcaagaataatttatataagaacttcccacactatatcacttatcaacataaatctatatacattttatttttttcaaacatagctttaattaacatttttaattgatttcacatctcgaataaaaaagtttaatgctaaggaagtttattacccaagtctttcacaatccatataatttatttaaagctacaatatcgtataaagaagtgtatgctaaatttagcataaaatttatcaacaaaaaacctacaattgacacatcaagatccatttaagtttagcaaacaaaaaacttctttacacaaataacactcttcacattaagatactgctatagtatttatcatctacactttagtttttataagttcagcatatatgtttcataagatttttgcaaaaataggctctggttttggtaaaactgtattcatatttataggtatagaaaatcgactaaagtcacgattacattctggtaaaccaatttgatctaatattttagatgataatttaggcatgacaggttgcaacagcaaccctatacatttaatatattcaagtaatttatacaatactgcttccataattttagggtcactcttagataacctccatggcgctcgtgatgcaatatattcattagctgcagaagataattgctctataatatgtatcatctcattcagattacaacgcattacacaatctctaaccttttcaagaatctcttgataatctggtaatacttcctcaccctgcagcaaattgccacttactgttggtactatccctccacattctttatacaatagtgaaacagttctttgtacaaggttccctatattatttgctaaatcataatttatacaattaataagactatttcttttaaaatctccatcgttccctattggcatttctttaattaaaaaatatcttaattgatcaactccaaattcttctactaggtcaaaaggtttaataacattacctaacgacttagaaattttttgcccctcattagtccaccaaccatgtgccaagatttttttaggtaaaggcaattcagctgccattaaaatagcaggccaatatacagcatgaaacctcaatatatccttacccacaacctgtaaaacagaactactatcacttgcccaataagcttgataatctttatggttctcatcaggaaaccctaatactgtcaagtaatttgctaaagcatctacccaaacataaattacatgtttatcatcatttggtacttttattccccataaaacattttgtcttgatacagaaagatctttcaaccctgatttaacaaatgatataacttcattataccgatatttaggaataacaaaatcaggattttcctcgtaaaaagctaacaacctttcctgaaaatttgacaatcgaaaaaaataactcggctcttctatccattctacatcagctcctgtaggagctttaccatcgaccaattctttctcctgataaaacgtttcatctcttaccgaataccaaccagaataactacctaaatatattgccccattatcacacaaacgctgccataaagctaccacagtctttttgtgccttgtttctgtcgtacgaataaaatcatcatagctatagttcataacatcagctaactgtctaaaaacagcacttgtattatcagtaaaatctaataatgacatgttacgttcttgggctgctttttctattttttgcccatgttcatctgttccagttataaactttacactatgtccatcaagacgcataaaccgtgcgataatatcagatatcaaagttgtataaacatgacctatatgtggcacatcattaacataataaataggagtagtaatatatatattattcataagttagcattgttattactttatacagttagcaaattatcacataattttagttatattaacttaatatttgcagatattacaaaatattgacttataaaaactatatacaaacataagccctaaaacagaccacttttaattaatcccatataacagtaactactagtacaaaatgtacgatactaaacacgattatatacaagatgacatcaatacacattactatgagtcatactatcacaattcattacacaataaacaaccacattaatttctacataagcagttttaacatcctttactgacccacaatttcataaaaaaaacttagaacagcaatttgcggctttgcttatcctcattgctatagaaacaatactcccaactgaatgctcttatttttataaaaatttaaactagaccaaccatatttttccaagtagtacgtaagataactatacaaaaacacaaattatgattaccctagctgaacaaaattgataccttccacacaaaatcctacttttctaataactattgtttcacaatattaattatataataaagaatttaactgtattaatacaaactttgcaaaatataaaaaatcacttatcatttaattaacagtcatatatttctagcacacaacaatgaagaggattttagtaaaaaaatttggaggaacttctttacaagacatagaatgcattaatagagttgcagaaataataaaacaagatgttaacaataattataaagtagttgtagtagtatcagctatgggaaaattcactgataacatcatttcacaaattaaacaaatttccgatgtcaaatctcaatctgaacgctccgaatatgatctaatcatttcttcaggagaacaaatatcatgcggactattatcattagctctacaaaaaataggaatcaatgctcaatcatggttaggatggcaactaccaatagtaacaactgaagaccatactaaagcaagaatcatagatattaacacatgttcactacaggattcactagctaataatgatgttgctattgtggctggatttcagggaatgcataaaaacaatagagtaacaaccttaggcagaggaggttctgacacttcagctgtagcaattgcagcagcactaaaagtagatttatgctacatttacacagatgtagacggaatatatacagcagatcctaatgtggtaccaaaagcacgcaaattagattacattacatatgatgaaatgatagagatgtcttctcttggcgctaaagtattacaagtacgttcagtagaaatagcaatgaaatataacataaaattgtgtatattatctacttttaatcctggaaaagggacaatcttacgcaaaaaaggagaatcagatatggaaagtcaattaattactggggttacatgtaataacaaaacagcaagtattacactaaaagaggtaaaagcaatatctggcgttaccacagtatttaatgcaatagcagaaaaaaacattaacgtcgatatgatcattcaaagtgtgaatgataacaatgcaaatgatatcacttttacaatttcagaagaagatttgccaacaacaacaaagtttttaacagaaattcaaactgaacttatgtatcaggatttaataatcaattccgaagttgcaaaagtttccattattggagtaggcatgatttctcattctggagtagcttacaaaatgtttgatactttaacatctaataatataaaaatattagcagttactacttcagagataaaaatcagcgttctaatatcgagaaaagacagccaacttgcaacaatagcattgcactctacttttggacttgataacacagaatcagatttacacataataagttaatctatttataatatagcttataacccttctggtgtttagataacgtattacatataagtaatatagttttaagaattattaaacaacaataaacgtagcacttatttttaagcttctatgaattctgtttggattttctataaaaatcctttctatgaattaaagttcctacattacaacaaacactactttagaactagactatgacagctatattttttaagatttcaatttcttttatcttaaacttaattcagcatagatcatcataaacaacataatacttataagtcatcattaaaaaatgatttcatatctctataaattttatattagaaagcaattattacctttaaaccagattttggaaccatatcaattaagtcttatattacttagattttagtcaattactttaatttttcagtcttcaatttaacaataaattaatttgtaacataataaataaaggactctttagattaaaaattacattacacaagtttttttaatctataaaatgcaacatatacactgaaaatttgtaaaatccaatctcttctggaaaaaatttgcaaaatacttttcaaatataacgcagataggtttacaagtactgtagcttttagctataatcaaacgatagcttttagctataattaattttataagtctatacttcttaaaaagtagtataaaattattgcattttggtcctcaaaatgataaagatgaacggttaatagtgtaacattatgttaagatttctgtttttttttctctttatgtttagttctcttgatctatttgcagcacctgtgcagtggcaaatggggtttcaagctcctgcaacagaaataatggagtccatcataaggtcccataactttgttatgtttgttatgtcaggagtagtagttgttgttttctccatcatgatctacgttcttataaggtttagaaaaaaaccagaagataaaattatcttcaatactaagaattctcataatgtagttttagaaatactgtggacgttaattcctttaataattgtaggatttttaaccataagtaatgttaaactaattagacaagaacagaagattcctaaggtagaaatgacattaaaagcaattggttaccaatggtattggggatatgtgtatccagattataaaaatttcactttcgatagttacatgaaaacaacagataatttggaagctcaagatttacgcctacttgaagtagacaacagggtagtagtacctattaacacaaacattctgctacaagtaacaagcgcagacgtaatacatagttggacagtaccagctttgggagtaaaaatcgatgcagtaccaggcagattaaatgaagcatggtttaatataaaaactccaggagtatactatggacagtgttcagaactttgtggaagactgcatggatttatgccaatagtaatagttgctgttgaaaaagaacaatttgacgaatggatacaaaaaaagacacttgaattatagaggcatgcatgagtagtgaacatacaccacaggggataagacgttggttgttttcaacaaatcacaaagatataggtacattatatatcattttttccattattggtggacttgtaggtggtataatgtctcttgtactgagattacaactagcacatattaacgtattacatgataactatcaattatataatgttattgtaacagggcatgcattaattatggtgttttttatgatcatgccagctttaactggaggatttggtaattggttcgtaccattgcttataggagccccagacatggcattcccacgtcttaataatgtaagcttctggctgttggttgcctcactaattctattatgtatatctgtcttgataggagaaggtgcaggtacagggtggacattatacccaccattatcatatatcgggtctcatccaagtgcttccgtagatatagcaatattcgctatacatgttgctggagcttcatcaattgtaggagcaataaatttcattgtgacaatattcaacatgcgagctcatggcatgacattgttaaaaatgccactattcgtctggacaatattattaacatcttttatgttaatagtgacaatcccagttttagggggcgcagtaacaatgctattaacagacagaaattttggcacaagtttttttgaccctgctggtggaggtgatcctttattattccaacatctattttggttctttggacacccagaagtgtatataatcatattcccagcatttggaataataagccaaattgtatccactttttctcataaagcagtttttggatacttaggtatggtattagcattagttggcattgcagctgtaggtgcagtagtatgggcacatcacatgtttactgttggattaagcgcagagattatgacatatttcagtgttactaccatgttaataggtgtgttaacaggagttaaagtattcagctggattgcaactatgtggggaggacaaatagaatttaaaactcctatgctattttcaattggatttatcttcgtatttgtagtaggaggagttactggtattgtaatttcacacggtggtatagataaagcactgcacgacacatactatgtagttgcacatttccattatgtaatgtcaatcgctgcattgtttgctgcctttgctgctttctattactggataggtaaaatatcaggtaagcaatataacgaatgtttaggtaaaatacatttctggttaacttttattggaactaatattacatttttacctcaacactttttaggtgtagcaggcatgccaagacggatcccagattacccagatgcttttattccatggaattatatatcatcagtaggagcattgatatcattcatatcagccttattttttgtttacataattatttcaacattaagaaatggaaaaaaatgtcctagcaatccatggggaggagatacattagaatggacaataccatcaccagcacctttccatacctttgaagaaataccaaaggttgattaagcatgagttctaaatgtgaaagtgttaaaccacagcttgtaaatgaagtattaggctattgggatctactcaaaccaaaaatcatgtatttagtagttcttacaggaattacaggaatgattattgctccaggaaatattcatccttttatcggtatcatcagtaccttatgcatagcactaggatctggtgctgcaggagcaattaatatgtggtatgacagtgatatagacgcattaatgcaacgtaccaaaaatcgtcctataccttctggaaaaattgctagatctactgcaattgaattgggattagtgttatccgttatttctgtaacagtaatgatgatcgccgttaactatctatcaggaatattactagctatcagtataggattctactcacttgtatacacaatgtatcttaaaagaagaacaccacaaaatatagtcataggaggaattgcaggagcactgcctccaattattggatggacttctgtaactaacgccatctccatagaaagcttgatattatttctaattatatttgtatggactcctccacacttttgggcattatctttattaaactatcaggaatacgaaaaggctaaagtaccaatgttacctgtcacacatggaatattcactaccaaaatttatatactagtatatagtatcatactatttattataacactattacctggaatatttttaaaagattgtttgttatatgaaacttgtgcaataccacttggcatgacattcgtgttccatgctttcaaggtatttgtatcaatcaaccactataaatacaaagcaatgtttacttattctattgcttacctctttattttattcatatgtattattatctcaagtttttaacatcccttttaattaagagattccaaaacatcaataaagcctcactacaattataaactattctttgttatttaaccaaaggttctttataccatccagtatcaatacaacattctttaagtaatgacatatatcttgcataggcagcaatatcccccaaagctaagtacgcttcagcaattctatataagctttctgaataatatttcgtatccttatacttatttaatattgtactaaacctttttatagcagcaacatattcaccacgttgcaaataaaacttacctattgaaaattccttaccagcaatatgttgatgaacaagttctaatcttttcataacttcttctaaatacatagagttgggaaagagacgtataaactcattcaacaattccaaaactttatgcacactactttgatcacgatctatatcactaatttgcatgtagttcgccattatccttaaataatatgcaaaatctatatccttactatcaggataaagttgtatataatcatccgcataaatttcagcacgagaataatcgccaagttcataattcaaaaatgacatcataagacgagcttttatcgccacaggagaaaatgggtaaagattgtctatttcctcaagatcttttaccgcactcttatattctttggcattagatttctttaaggcactctcatacatttcatctgctgttcgatcttcaacaaatttttctcccttctttatgaaagagcagtttaccattaaaaaacaacaacataacaagtaaacagccttgcgaataattttagagtgacacatattcaatcacctataaatataacttgtaaatatataaatatcctattgaaacataaagatgtatcccagacaagcaatttttactaatgtacttacactagcaagaccatataatgtattgacaactatcatattgatactagaatgcaataagtacaaactaataaagcatactaatgaatgtattggtgattggttctggcggccgtgagcactcaatgttgcatcacattcgtaaatctacattactaaacaagctatttatcgccccagggcgtgaaggaatgtctgggttagcagatataatagatatagatatcaatagcacaatagaagtaattcaagtatgtaagaaagaaaaaattgaattagtagtcatcggaccagaaactccattaatgaatggattatcagacgcattaacagaagaaggcatattagtctttggaccttctaaagcagcagcgcgtcttgaatcttcaaaaggatttacaaaagaattatgcatgaggtatggaattcctactgcaaaatacgggtactttgttgatacaaattcagcttacaaattcattgataaacacaaattacctttagtagttaaggctgatgggttagcccagggaaaaggaacagtgatatgtcacacacacgaagaagcatacaatgctgtagatgccatgttagtgcaccacaaatttggagaagctggttgtgcaataattattgaagaattccttgaaggcaaggaaattagcttctttacattggttgacggatccaacccagttatacttggcgtagcacaagattataaaactataggagataataataaaggtcctaatactggagggatgggatcatactctaaaccaaatatcattacacaagaaatggagcatataataattcagaagataatatatccaactattaaagcaatgttcaacatgaatatacagtttagaggtctgttattcgctggtattataatcaaaaaaaatgaaccaaaattacttgaatataatgtacggtttggagatcctgaaacacaatcaatattaccaagattaaattccgatttcttaaaacttttatcactaacagctaaaggtaaactaggaaatgaatcagtagaattaagtaaaaaagctgctttatgtgttgtggtagctagtcgtggatatccaggtgagtataagaaaaattctataattaatggaatagaaaatattgaaaagctacctaatgttcagctcttacatgcaggcacaagaagagaaggaaataactgggtatcagattctggaagagtaataaatgttgtagcacaaggtgaaaatttagctagtgcgaaacaccaagcctacgctgcattggacttattagattggccagatggaatttacagatatgatataggatcatgtgctctttaagctatactctatgaatatttagcataaaattagataaagcacgatttaattgtgcaagccgatttttgaatattacaaatcttgatccagaaagttttgtggcttgtgtgaaatccattaaatttaaattttccctaattcataatgagtttttactggaaaatcaaaacttgttttattctcgtatcttctcaattcaacattactgttttcgtctttcctaataggtactcttttatctggtatatttggcaacatattgagaagattaactaattgagaatcttcttttatcatgttgttaatatcgtctattttacttgctacatctttcgataattatatttgtatattttaacattatactgatattgcttatttgaaattactaatattaccaggtgttctttttaaaatataatagcacaaactacatgtcacacttttgtaaccctcatttgttacatcgcatataatcacatccaatctccatattacaagcaattaccaatcgataacttttaacataggaagtaaagtttgatctatcactaaaatatgtatacttctattatacccataacttaaactcatggttactttgtatattcgtaatcaccaacagcagattatttttcaaaataaatagacaatttctatacaggacattccactttctaataacgcttatgatattctagctaatttcctatatattagattttaagccaaattgatattgacaaccaacactattcttgatacattgattttattaacctactctttggtattaaaaatgtcacttatctctgaagtctttgcagcagcagcaacaacagcacctgcttcgggaataggtagttcaattgcaggtttaattcccttagtattaattttttgtgtcttctatttttttataattagacctcaacaaaaaaagattaaagagcataataaactgctagataatataaaaaaaggtgataaagttgtcatttctggcagtatactgggatcagttacgaaagtcgatacaacaaatgggcactttattgttgaaatatcagaaggagttgaagttaaagtattaaagtcttcagtatctgaagtgttgaataaaaataacaagcctacttcaactgcagaagcatcagttgcagcttctaataattaatacataactaaatcttcattcgagaaaaagagtgtttatatttccttattaattttaaggacaccttttttaacaaacagccaattttagataatataaaactactaacagaatttaatataacaaattctatattctcataggcataataatgtaagtgaaatcatctatattttcttcttcctgtattaaaacagatgtaccagcatcataaaacgataaaagacattttccttttatacaatacaaagcttccattaaatatctggcatttaaaccaatagtcatgtcttctccagaataatctacttctaattcctctctagcatcaccttgatctgaagaagcagcacttaatataagtttattactcacaaaccttaattttatcacttttactttatcaaagactactacagatactctatctatcgcattagataacgtttcagattcaattaatacattcttatcatgagatctaggaataatagaattataatccggaaaagtaccatctattactttagatattaaaatatattctttatactcaaaacaaatcttcctatctgataaactaattgatattaaatcattaccactaccatgacttactatcttcaaaatttcattaactgtttttttgggaactataataccaaaatttgacaatacattctgagattgactcaacttagttaacgacaacctatgtccatctgtagcagcacaacataagatattattggacgtatgaacatataatccattcaaattaaatctactctcttctatggaaattgcaaatttagttttaccaaacaaactaaccaattcagagacttgcaaagtaaatttgttttgtaattcattattttcaataataggaaacttctctatatcaactacaggaagaaaaaactccgtacgaccacattttatagttaatcttccatcttcaccaataaaaaatttgatttcaatatcattaggcaacttttttacaatatcataaagaagttgagcagacactactacaactccattaacgtttacatgggcagtaatagatgcaattattgaaatatcaagatctgtagatgttaacttaatttcttgatcccttgcttctattcttacacacgacaatacaacaatactatgacgtttttctacaatactattaatgtaagacaaagcttgcagtaatttatctttgctaacaaaaaagttcaacttaataccatcactcatatatttctatataaacctaccccattgtgatgttatacaaattaaacttaaacaagtcaaggtatggatcactttgctctatactatgatataatcacacatccaatatcactctagcacaaattaagttctcccaaaatacacttaaaatactctatttaactatatgctacaaattttcaatacaaaatagaatcaagtaaacaatactcagtattataaatttttcaaactcttcttctatactattgatgcactataacaatattatcctgataaatagacttttaactacttgttatagcaatttaaaagaccatcatcgcctatttatttcacaatgtgtttaatataacaactctcaactcttttaatcgctaagttaacatctacagatcttgatatttcaataattgcatctattactgcccatgtaaacgttaatggagttgtagtagtgtctgctcaacttctttatgatattgtaaaaaagttgcctaatgatattgaaatcaaattttttattggtgaagatggaagattaactataaaatgtggtcgtacggagttttttcttcctgtagttgatatagagaagtttcctattattgaaaataatgaattacaaaacaaatttactttgcaagtctctgaattggttagtttgtttggtaaaactaaatttgcaatttccatagaagagagtagatttaatttgaatggattatatgttcatacgtccaataatatcttatgttgtgctgctacagatggacataggttgtcgttaactaagttgagtcaatctcagaatgtattgtcaaattttggtattatagttcccaaaaaaacagttaatgaaattctgaagatagtaagtcatggtagtggtaatgatttaatatcaattagtttatcagataggaagatttgttttgaatataaagaatatattttaatatctaaggtaatagatagtacttttgcgtcagattacatattataaatatgactaaacgacattaacactactacgataattgaccaatctgttaaacaaaaactaaacctactaccctctatatactacaatacactcaatgttataaacccatgaaactactggcactataatatacagtaaaatacataacattacctaaatagattaaagcaagttcttgttaccgcacacaaattgaacatcataaacttctattcatttctataacataataactttaagataataaataatgcataacacatagctatacaattctatcgtaaaaaattacttagtactatgatgcatgactaaatatatcaacaccatcccaacctaatagatcaagctgagcccttgttggaagaaatccaaaacaagaagctgctaactcctgtttattctcacgctgcaacatagcatccaatttgttctttaatgcatgtaaatatataacatctgatgctgcataatttaattgttcagacgttaaagtttcctttccccaatcagatgactgctgcattttattaagtttgacatttaataattcataacatagctcttttaacccgtgatgatctgtatacgttcttactaactttgaagctattttagtacaataacacggtgtagcccatacaccaagataataacgtattacagcaatatcaaagcgagcaaaatgaaagatttttgttatacttgaatctgaaagaacacttactaaattaggtgcttgataactacctaaaaactttactaaatgtgtctcaccattactatcacataactgaactacacacaacttatcccgcctacacactaaacccatagtttcagtatcaacagcaacagtattttcaaattttaacccattaggcaaatcacaatcatgtacaaatacaggcacgtaaatttcctccacctacaaagtatatataatacctttgttcattgtatcatgtagtaaaatgcctctcaactatattatgcttcctcaacatactttttatcttcctcttgaccataaattgagtcaacattggcaccaccatgatcccatctatatcctcctctatcatcactttcatcttcgtcaacacactcttttaatacataaccacgtccccaaacagtttctatgtagtttttcccattattagcgactttaagtttcttacgaagcttacacataaacacatctataattttatcatcagaaggttcatctaactccctatataggtgagataaaaacatttcttttgtaagaacagtacctaacctagatgataacaactctatcatcccatactcctttttagttaaatgcactatttcaccattacattcaacacacttatgatcaagattgattgcaatatttccaacacgtactattgattcaggatgtcccctagtacggcgcacaatagcttttattctcgcaagtaattcacttttatgaaaaggtttagtcacataatcatctgcaccataatataaaccttttactttatgtgatactgatgaaatacatgataatataagaactggaactttgataccagactctcgcagtttcactaaaatatcatatccatctatttttccaggaaaatgtatatctaatatcactacatcatagtcatcattcttcggaatgatactaccataacaatcctgcgcagaagtcatagtctcacaaaaatgcccttctgaagataaagaagcttctactgcctttgcacatgcaatatcatcttctattaataatatacgcataaaatacctctaaaaacccaataattaacaaacttaacacataaagcacttagcactaatctaaagacataatcaccctataacaactaaacatttcatcaaaagttaatacatagtgttactatgctattcaagtataatagtaaattacatgtaatatactttccttgtgttgcatatataacacaatattaccccaaagactattagagacattatagtaaacacacctatttttccttaattagtaaaatacttcactgattatatataagcacaagttaatactttattaataataaaaatggttaacacacgtactactatacattaataaaagcattcacactaatataaaaatttcaaaatttgatatctattttactcataaagatcttgcataccaaattattctccctaatatttccatatcttctaaatgacactcataagaagaatattttttattatcagaaactacatgtaactttatcttctgattatcttttaaatactctaatctcctaattgatacacctactgaatcaactataacaaataatccagcaggatgaggaattttatctcctatatccactagaactacatcttgattcattaatgttgggatcatactatctccctttacgtaatatacacgtaaattcttcatattagaagttaaattaatgtttgaagagagatacaaattaacatcacctgaggatgcaactttaccattttccaattctaaatcatatacaggcattatattaacattattctgtccataagtataattatcatcactaataaaatatgataatgaaacgtttaataccttcgctattgccattaattttttagatgtaggattcgttgatttaccacttaatatatcatatacaaaagacttaccaacatcagctttatgcgctaattcacgcgcatttattcccatcttatccatttggtatctcattctagtaactatcatactattatcactacttgttttcataaattcaccttacagttaatatttattacatttttgtacaatttaaagtacataaactcaagtaataattgaattattcattaatagagaataccaaatcataaaattactagtgagtaattataaaatttacacaaaatcagtgctaacttataaaaataacttttccataaagttatacatagcagagcttgcattctattaaaatctacatgcaatttgataattaactaaaaatactaaccaagtagcaatagcaacctaataatcttcaccattgctaaaaaatagaacccccaagcattatttataggtgatccatattttttataaagtcttctattttagcaatccatctttgcaggataacaccccaatataaaaaccattactacaccaattaaataaaacgcttaactacaaaaccttatagtcatttaataaatcaactacaacaataaaaatcgcttacagtagtacttcccagattatcaatttcttataaatataagcactgtagcactattacaacctaacactacaacatttatttaattaaagcacttaatatcaatttttctgcaaccgtaacatctttccaaccttccacagatacaaatttatcttcctccaattttttataaaaagtaaaaaaatgggatattgaatttaaaaaagatacaggaaaatcggaataatcttttatattattatagtattggtctactttatgtgtaggaacagctaatatttttacatcttctccactttcatcatgcataactaaaacacctactggccttgcgcggattaccgccccagacattacaggaaatctagatgcaaccaaaacatcaacaggatcaccatctccagcacaagtatgtggaataaaaccataattacatggataatacatagatgtaggtaaaaacctatctacacaaaataaatttttctctttatcaaactcatactttaccggacaggaattctgactaatttcaataataacattgatttctttaggaacattatcaccaccagtcacattgtctaaattcataattaatctcttgatatcacaaacaaataaaaaaaattttgaatagatcaataaatgaccatcagcttatatactaatatcctttatattctagtcaatgcttttcttaaacaggaaatactcataatataaagatttttaacaatataataaagctctatatacaattacattgacataataatatttttatcacctacactgtattattgcaaaatataacattaatcaagtaatacaaaaaatgctatattgcttaaccaacccacataattacttacaaaaacataccacatactgatacattaaaagaagacaatactgataaaacagttttcttaagaatatatcacaataattaaatcttatgccacttaattaccatagtaaattatctataaaaacacataacaaacttacatatctatgtagacaatgaagtacctattgcaaaatataacattcacaaagtaatctgttacttgtacacaaaaatcccatactgcctaaccaaccccataattacttacaaaaacataccacatactgatacattaaaagaagacagtactgataaaacagttttcttaagaatatatcacaataattaaatcttatgccacttaattaccatagtaaattatctataaaaacacataacaaacttacatatctatgtagacaatgaagtacctattgcaaaatataacattcacaaagtaatctgttacttgtacacaaaaatcccatactgcctaaccaaccccataattacttacaaaaacataccacatactgatacattaaaagaaaacagtactgataaagcagttttcctaagaatatatcacaataatcaaatcttatgctactcaattaccacagcaaattatctataaaaatacatcacaaacttacatatctatgcagataatgaagtacctaaagtaatcaacctgatgaccaatacatcaaaataaatcaaactctatacttctatcaatcacacagactatctgtctaaaaaacagatcttaaatttatatactttaaagtaaatatttaaaaataaggaatatttgacaaagcaattttctcatcataagacatcataacattaaaattttgcactgcttgaccagctgcaccttttaataaattatctataacagacatgataataatcgtgttaggtacccttccaggaaaaacacctaaataacaataattcgtacccacaacagacctagttgtcatagctttctcttcatcaataaaaacaaaagatgaatctttgtaaaaaagcaacaatgcttcacggacatcagtaagcgatacgccttcttctaactcaaggtatatactagacatcatacctcttttgacaggaattaaattaggcacaaattgtaaattaatgtcttctctacaggcagcaaaacaaagctcttgctctatttcaggaatatgtctatggtctgaaattttatacgatttaataacatcataaacttcacagaacaacttatcctgctttacagacctaccagcaccactcacacctgatttagcatcaactattataccctgactttttattaaacaaagtcttaacaatggaaataatggtattagcacagaggtaggataacatcctggacaagctataaaccttgacctttgaatatcttcccaatatatctccgttaacccgtatacaaaatctcttacaagatctggacaacaatgtgagccataccattgtttatatacttcagcatccttaattctaaaatcagctgataaatctataattcttactacatcatgaatttttcttacaacttcacttgatgtaccatgaggtaagcacaaaaaaaccacatctactttagataagtcaatatcatcaaaagacgaaatattaacggatatatcatcctgcgaaatgtggaaataattagaagaaagtaactttccactagattgagttgcacataaatactttatcttaaccataggatgagataataacaaacgtactaactctacccctacataacctgtagccccaactacagcaactgatacttgataactcatttaataggttatcttttagagaattgacaactttttctagccttatgttgaccatactttttacgttcaacaacacgcgaatctctagtcaagaacccaccacttcttaaaataggatgaagactaggattaatatctttcagtgccttactaattccgtgagcaacagcacctgcctgacctgaaatcccaccaccactcacagtagcaacaacgttataacacccagaagttgatgtaacaataaatggattataaacctttctacacaaggtatttttcttaaaatagttaaaaatatctaaaccattaacagtaacattccccttacctactgttaaccatacccgtgcaacagcttcctttcttctacctgttccataagcacggccacgagcatctacttttacagctttgatgtgatcatcttgttgatgatcagataacatatcaggacttttctccattatctcctcttattattcttagcatttattgataaaaaatctaactttacaggttgttgtgcattatgcttatgttctggacctgaatatacatataaattctttaaacgacgacgcgccatcgggccagtactcaacatacgacgtactgccatattaattatacgttctggatgtttatttaaaaacaaatcagctggcgtacagctttttagtccaccaggatacccagtgtgcctataatacactttatttttcaatttactaccagtaaagtgaaccttttctgcattaattataataacattatctccgcaatccatatgaggcgtatactcaggcttatccttaccacgtaatatattagcaacaaaagcagcaagcctaccaactactactccatctgcatctattacaacccaacgcttctttatctgacttgcttttaaagaaaaagtctccatttgcatctatcgttaataaattttcatagtaatcatacaatcaatttttgtcaataaaaactaattttatttactcttcatgtgagtcctatataacataactttgatattccaacagtaataaaataaaatgcaaaagtatgctatattcaaattgctgattatagataattaacaagtaacaaagatctcttttattttacagtccttaggaaaaatttgtactactcatataccttacgcattacaacttatataagacgtaataacattttaaatacatatccttataaacccaacacataaaagaccttaaaacttatatttataatacaactcatttgaaatcaactacccatttatattccatttctacagtttattgcaataaaactccgaaacttataacctatgcttaagtaataacatagaattgaattaatcaaacttcacacttaattcttgctaatcaaaattaattacagtttaatcattgctagtattactagttggtaacatttaatgataagcaaatttaatatacgtaaggtttgttatacattgatattgatatctatgtcaattatacctaataacagttattgtactaacttagatgaagctttacaggctgcattatcaaataaccccaacataaaagcaaaattctatcattccttagggaataaacaaaaaattaaattgaatagcatatcaaagtttttaccatcaattgcatactccgtgcaggtacatcagccagaattatctctaaccaacaatagtaatagaactatgagcctcatagttactcaacagctattcaatggaggagctgatgccgctgcttttcaacaatcaaaatacttaacaaatatagaagatattgatttttcactagagaaacaaaatgttatacttaatacagtaaaagcttacatgaaggttttaacaacagctgaggtatataagttaacacagcatactaaaaaagtattagcagaacatttaacagccacacaaaaacgtttttctttaggagaagttactaaaacagatgtctcactagctactgctaggttatcatcagctacatcagaattaatcaaagctcacggagaaatgaaagttgcagaagctaactacattcacataacaggagaaataccaacagatttacaaaatcctgctataccagcaataccatcatctgtagaagaagctttagaaatagctcaaaaaaataacctttctctacaagcatctcacaacggatataaagcagctaagcagggtatcttaatggcaattgcacatttacttccttctattagcatatcatcaataaattcttatacttactctaatattcctaacacaaatcctaaaaaaattgacaatctatttgaaataaaaatgtcattacctatattccaacaaggattaaacatcgctgcaattgcacaatcaaaacttgcagcacaacacaagatgtattcacattatgaagtgttaaacacgattaaagagtctgttatttcaaattgggaaaatattttcactacaaattccatgctacaagcagctcaagattctgtgagatattcagaagtagcattattcggaataaaacaggaagcagagttaaatttaagaacagttctagatgtattagatgcagagcaagaattgctaaaagcaaaagtcaatcttgttaatgtacaaagtaatgtcgtgataagtatatacaacctacttgcattaataggacaactaaacattaattatatttaacatagaaatttatgagtaatactaacaattttcaatctattaaagaaacaattgcaaatattagaaaagccatgtctagcagcgataatacagatcctgtaactgcacaacatgatactgacaatgacgctgacaacgaagtacttaatttagaaaatccagaaaattctgtagagctacacaacatacaacatgtacacaatacattaaatgaaataaatcatacatttcaagcaataacagacttacctacaacaacatatcaaaataaaccagatatacaagtatctgtcacaaaagagaaaatttaccctgaacaattatctaacgtaaatcagttcatctcaattgaacaatcaactcaacggctatcatctcaagaaagaaggctaacaacaacacatactctttcagaagaagtatctaaaattgataacacatcagaaataaaaggtattcatcagcaaaatagttttatcactgaaaatttagtatcacctgaaagtatagttgcaagcagtgaagaaataaaaaagctaatcacacaaatacaccactatactaaaccccctaatatttcaagtgagaaaagtcctactgttgaagaactagtgataaacatgctaaaaccagaattatcaacatggcttaataacaatttacagaagttagtaaaggagattgttgaaaaagaaataaaacacatcataaagaaatcaaaccaaagctaactgtaggatttattaacttagtacacatattctattacttttctgaaatacaaactttttgagttattcatatttcacattctaaaaacataaatattaaaaacaactccgcataacttatctaaaaactgcatcaaggaagcaataaaacatatacaataagcattgccttacttcaatatccatttttcaacagcataaagatgcttaagaactatatgaaaaataacaattataggtatatttttacagcaaagaatttaaattatacaagtaatagtattttatttgaaacagatgtatacgtataaaaacactatgatagaaataatatcataattatttaatatattttttcaaacagcataatatattatctgtaatattatcataaattttacatatttcatgatctaatactaatgggtttcccagctctgctacattacatatttgaggatacaatgccacttccccaagaaaacttatgtttaacctatttgccattttatgtacaccttgtttaccaaaaatgtaagtcctacaaccagaatcaaaattaatgaaataactcatattctcgactataccaataatatgaacattcattttcttcatcatatcacatatctttactgcatcaataatagctaaatcttgaggagtagaaacgacaacaacaccagtaattttaaatctttcaacaagactaaggtgtacatcacctgtaccaggaggtgtatctattattaaataatctatttctccccacactgtattcatcattaaactatatattgcttttgttaccataggaccacgccaaatagcagcattatctttattaattaaatatccaattgacatacttttaataccatacttagtaattggaatcattttattactatggtctacttcaggattagtaacatctttaactcctaacatatgaggtatagatggtccataaatatcgagatcagctaatgctgacttataccctttacgcaacaaggataacactatattcattgccatggtagattttcctacaccacctttacctgaagatataagtattatatttttcacacctggaatcgatatcttatttgtagatatgcttttattgtgcttattaacagtatcatgtgcagcagtaaaaacaatctttacttctttaagattaggtatagtactaatcacatctctacattttttttcaatgatatttttttgttctatctgatacgcatctgacaaatttaatatacaataaacaacaccatcattcactaatacagacgttactaatcccaattcaacaatatttttattgctcttatgatcaataactgtcaataatgcatctaatacttcttgtttgtttaccactattatccttaaaaaagattaccctatgataacacatattattaaaaaatacctatttacttttagtaaaccattacgtattatcaggacatccattttacatatagattttttcgatgttaatatcttctggtacatctagtattaacttagcaaagtgcatatcaaacattacaagtataaagttagttaactcttgtatttctcgtttttctgatcaagaattaaacgtagaaattcaagaaaaccaagatgacaaaaataaacacgtcataattataaattcactttgttccccagcacatgataatttactagaattactcttgttaacggatgcaattaatagaacattgcatcctagaaaaataaccatgataataccttatctttgttacactagacaagacagagtaatgtatagaaacttagatgacaacagcctaatggtctctgcattaagtgcaaaagttatcattaacatattaagaacagcaaacattaacaacattatattcattgatctacattcaaatcaattatctggtttctttgacatagcaactactaatttaagttcccacactgttttcataggagatattatagaaaaacataatactaacaacttagttgttgtatctcctgactatggagcattaaacagaactcgaacttttgcaaacgtattatcaaaacagtgcaaattacacaacgaaattcaagtagcagtaatagataaatacagagcaaaacctggtgtatctgaagtaatgaacataactggtaatgtagaaaacaaagattgtataatagtagatgatattgtagattcagctggaacattatgcaatgcggcatcagctttaaaagacaggggagctttacaagttagtgcatatgttacacatggaatattatctggcaatgcagtagaaaaagttacgaattcaaaacttgataatttaataataacagacacaatacataatggtttcttcaacacatcaaaaatccgaattttatccattgataaatttttaagcaactatatactgtataatttagtataagtttaggaataaattgatagaagataaatttgaaaatagtacacattcaaaaacaagcaagtcattaactaaaaatgacatattgcaagctgcaaagttaactagaataaagctcaatgatgaagaaattgattaccaccttaaagaattagaacaagtgttaaattggatacaaacaatatcagaagttgatactcaagatgttactccaatgggtcatggtggtgtaaattatgctcttcctttacgtaaagatattatcaatgatggcaatataaaagacacagtattatcgcaatctcctaaacaagaacatgatttctttgttgtaccaaaagtaatagaataataaaaacatacacacaaagaattagagcaacacagaacatcataagtcaacactcaaaacactatggctattggtagaaacataccgatgaagaaattgattaccaccttaaagaattagaacaagtattaaattggatacaaacaataccagaagtgatactcaagatgttattctaatggctatagtagaaacatacaagatgaagaaattgattaccatctcaaagaattagaacaagtattaaattggatacaatacccagaagtgatactcaagatgttactccaatgggtcatggtagtgtaaattatgctcttcctttacgtaaagatattatcaatgatgaatgacaacataaaaagcatagtataccccagctttttgacaaaaatatatttgctatattaaaaatgcttgagaataatatgcacctcatagttttgacaaactgtacacacttgatcttatattgcaaggtatataaactccacttgtgcaatactggcttataatatacctcttacaaaataaacaaaaactatatcagcatgtatcttttatgctcttcctctacgtaaagatattatcaatgatgaaggcaacataaaaaacatggtataccccagctttttgacaaaaatatatttgctatattaaaaatgcttgagaataatatgcacctcaatagttttgacaaactgtatatatttgatcttgttacaaggtatataaaatccacttgtaatattggcttataatacactttttcacaaaataaacaaaaactatatcagcaacactaatggaattttataacttgtatctttatttcagcacattctacagaacttacgtatccgcattggatagttacagtattatgctccagtatactaactaacatatattatatgtagtacttgcatacttctacatgtccaataattcaaagcttacatttttttactatataagaagtacatcaatacatagcatattatacttctattcttctaatatttttagacccatatcgtgacttgttgtagtatttatcaacaacatcctagttcaatactgtaaaacaccaccacttttaaaatagccaactttaatagcattgagattacaaattaatcttatacttctacgagtttcttttctaacaataatacattctacttcctgattcataccaatctcaccaacaaatgtcatcacataatagcactttgcaccgttcagtagcaggtaaaacatattactttattttttttgcattatatagtgtatagatcagcactattaagtttatggtgtttactacaataacatatattataaaagtttagctggacatcatcttcattagtacatactgtaaaacaccaccacttttaaaatagtcaacttcaatagcagtattgagattacaaattaatcttatacttctacgagtttcttttctaataataatacattctacttcctgatttataccaatctcaccaacaatactaatttcttcatcacctacaagatttaaagttttccttgtatctccctcttcaaagattaatggtaatatacccataccaataagattagatctatgtatacgttcaaaactttcagctataatagccttaatattcaaaaagaaagtacctttagctgcccaatccctacttgaaccactaccatattcttttccagcaataacaaccaatggtatgttattttgttgataaagttgtgatgcatcaaatatcgacatttcttcacctgtaggcacatatttagtaaaaccaccttcacaacttaccatctcattacgtacacgaatattagcaaaggtaccacgcgtcattacgtgatgatttcctctacgtgagccatatgaattaaagtctgatactacaacattattctgcattaaaaacttacctgctggactattttcagcaatgttaccagctggagaaatatgatcagtagtgacactatcacctagtaaagccaaaattctcgcgttattaatattaagattattattgatatccatattaggagataaatttttaaaataagtagggctctgtatataagtactatctatatcccatgcatagatatcactatcaatacattttaaatcttcccaatatttccctccatcaaaaatattcttatatttatcaacaaacatttgtttattaatagtcttacaaataacttcatttatctcatcattagaaggccatatatcatgcaaatagatatctttgccatcatcatccacagctattggatccaaatgaatattaatattaacagttccagctaaagcataagctacaacaagaggaggagaagctaaaaaattagcttttacacaaggatgtattctcccttcaaagttacgattaccagatagtacagatgcaactaccaaattattttcttttatatttttctcaatatctgaacttagaggaccagaatttcctatacaagtagtacatccataaccaaccaaattgaatcctaatgcatttaaatctttttgtaatcccgacttaaccaaatattccgtaacaacctgtgaacctggagctaatgaagtttttacccatggcttagattttaaatttaacatatttgctttgcgcgcaacaagtcctgcagcaatcataacactagggtttgatgtattagtacaactagttattgcagcaataacaacatcaccatcctgtaaagaactttctgctaaattaactgttgatcttgaatttggcaataggttctgtaacgttgcttttacttcagaaagaaaaattttatcttgaggtctttttggaccagcaagtacaggctgtactgtttccagattaaactctatcttatcatcataacgtggctcttctttggtataccacaaacactgctccttagcataggattctactaaatctatcagtgataaatcacgtcctgtcatttccaaatattctaaagttttattatctatcgggaaaaaaccacacgtcgcaccatactcaggagacatattagcaatagtagctctatcagcaatggataacccacttaacccatctccataaaattcaacaaactttcctacaacccctttacttctcaagatattagtaatagtcaataccatatctgttgcagtaacaccttcagacaattttcctgtcaatttaaatcctataactttaggaatcagcatagtaatgggctgacctaacattactgcttcagcttctataccacctactccccatcctaagacagataatccattaatcatagtagtatggctatcagtacctactaaagtgtctggatatactaaattttccttatcccatacaactttagcaatatgttctaaatttacttgatgacatataccagctccaggaggcacaacacgaaaatttttgaaagcattctgtccccattttaaaaacctatatctttctaaatttctttgtatttccatagatacatttttattaaatgcatcctcttttccataaaaatcaacttgtattgaatgatcaataactaaatcaactggtactttgggattaattatgctaggatcactaccattttctcttacataatcacgcattgcagctaaatcaactattgctggtactccagtaaaatcttgcattaatacccgagctggagaaaaattaatttcatagcttacatgcttattaacacattgtgctaatttctttatatcttcaactctaacattacgaccatcttcattacgtaataaattctcaaacaatactttcaacgaatacggcaacttagtaacatcaacccctaacttactagctgcagttcttaaactaaagtattcataacaattttttcctgagactaactttttcttcgcattaagagaatctaaaaactccacactatacactccttacttttttacctaaataactaaacatatcaatagaaagtttagtatataccattaaatctttaagttaaagtatccttagcaatttctcatttatgtttaggataacacatattacttatcaagatataaccttctactatttaacctacgctaaacaactcatatgagtagcatacttatcttacactataattttcaattaacgtaccaaaaacgtcttttttaatatattgcaatacattattcactcttaagtttgagtgaaggtaaatacatattaaaccatatattacaaatttttattaaaaattcagcaaaatatctactgaagaatgcactcactgctgatagcttgttacttaaaggcagattactaaaaagacaaaagcattaacaacccatttaaagacttttgtaatacttcaaatttaaactcaagcaatcataaaagattcattttaactacagatgcactttatttaatagggactacaatacaccctaaacacacaacaccagtaataaacaaaattataaaaacattaatgtggctttgtattaacataaggactatctagcgagaacatcggtatactaacataaaaaacctgtgcagcatcttcatccataaattgatattccccatgcatcataccagatggagtacttaaatatgcaccactagtatactcaaaaaactctccaggttttaatacaggctgtttacctattactcctaaacctgttacttcattaataacacctgttgaatcaatgattttccaacttctcctcaagagctggactgtagaattacttttattcttaactctgatgttatacaaccatatataacaattttcatgtggagcagattgctcttctaagtaacttggaacaactttaacttcaataagtttggtcatactataatattgtagtgtcataaacaacccttagctacataataaataatacatcaatttcaccaacatatcaacacacaatacctgaaatttatgattcgaaataatcaaaaatactgatcacaatcattaatagttacaaacttaccatatacaccatttcaattctacacaacttaacgttaacactataatgaatacagagcatacttcccagtgttacaaaaattacacaccttattatttaattgacttgtttttttgaggcagattattattaactttgaaaatacaacaacagtaaattgatcactatgctacacgattcatacatcggccctggatcaactattgggattataggtggaggacagttaggaaaaatgatatccattgctgcagcaaacttaggatataaaacacatttattaactaataacccggatgatccatcagtctacattactaacagtgcaactatatcacacaattatcaaaatacagaatcattgcttgagtttgcatctaatgtcgacattgcaaccttagaatttgagaacattcctactactactatagatatattatcacaaaaaatcaaagtttatccaggaaaagaagctttatacatttcccaaaatagaataagagaaaaacagcacataagaaatttaggaatcaaaacttcagattttagagtaattgataactacaacagtttagtcaaaaatactatagaactaggatatcccaccttacttaagaccacagaattaggctacgatggaaaaggccagtatataataaaacaacaagatgatttaagtgctttatcaactctcaattgggaccaatcatatattttagaaaaatttgtcaaaatttataaagaaatatctgttataataacaaaaagcatcagtggttctatagaattttttccaactgcggaaaactgtcatactgatggtattttaaccacatcatcagtaccagccctaatctctcaagagataaatgtacaagcacaaaaaattgctttacaaattgcagaatctattaatttagtaggtttattagcagtggaatttttcataacagatacacaagaacttatagttaatgaaatagctccccgccctcacaactctggacattggagcttagatgcttgtaacatcagccaatttgaacaattaataagagcaatatgtggattacctttaaagcctgtaaaattactttttccatgtattatgaataacatattaggagataatatacacaactattataaacatgaaaccaaggttaatgaaaacttatacatatacggcaagaaaaaggccactaaaaacagaaaaatgggccacattaacacattaaaattcaaccagtaaccggagcaactatcattagaaagtttagtttcacaatacaaatattcacgaatttataaatgaaataataaactacacagtacaccaaaaaaagcaaccagaaatacactcattaagagacaacattctcaactatttcgaaatcaaggttaatgaaaacttatacatatatggcaagaaaaaggccactaagaatagaaaaatgggccatattaacacagtaaaattcagctagtaaccagagcaactatcattagaaagtttagtttcacaatacaaattattcacagaatttataaatgaaataataaactacacagtacaccaaaaaaagcaaccagaaatacactcattatgattatcatatcaatacgtaggccatagactttccaaataaattgataatacacaaactacataaactactgataccaatcttcacaggtaatctttataactataccgcctgcttctttcttagtagattgagcattaacatctgcacaacccaccagctccaaaataattactattattttcagctaaaagcttccctgagttacattcattcttacctatttcctcccacaaaacttctgtcataaagtcctgatatggtataaatcttattctcttaccatctggtacattctctgattgataatatacaaatatacaaacacataacctattgataccaatcttcacaggtaatctttactataccgcctgctcctttctcagtagattgagtattaacatctgcacaaccaccagctccaaaataattactattattttcagctaaaagcttccctgagttacattcattcttacctatttcctcccacaaaacttctgtcataaagtcctgatatggtataaatcttattctcttaccatctggtacattctctgattgataatatacaaatatacaaacacataacctattgataccaatcttcacaggtaatctttactataccgcctgctcctttctcagtagattgagtattaacatctgcacaaccaccagctccaaaataattactattattttcagctaaaagcttccctgagttacattcattcttacctatttcctcccacaaaacttctgtcataaagtcttgatatggtataaatcttattctcttaccatctggtacattttctgagtgacgggttacataattattaactattctataatataacatcttcttatcatgaactaacttattactttttatcctttttttcatatcattaagtaatttcccagctccattcgctgtcaatttcacctcacaaacttcaccattatgtgaatatttatctctcttacaaaattcaatcatagcatctgttcctacagtatgctcattgtcaagaacttgatcacgaataccttgtaaatgtacttttataaaatatttattagattttcctgttttaaacatacccataacatattcaccaggttgtccttcttcacttttccaattttctatatcaattttaccagattgccctccactccagatttccacttttacaaagtcacatctgctaggcacattatatacatcagttagctttggataacgcagtaatacatccacatgcttgtcattttttaactgttcctgaaacttcaacaaggcagaatctaaagtattatcatgtggtgcaattttttccactgcatatgttttactttcaaaatgatcaacacacatccccatagaatgataatctaaaaactgcagttcactttgtaattttgtatctaaagacaacatctttttatggtcaacatcaaagtatctcaatacacaagcatcaaatctattagctttggtaaactgagttaaaatctcaggatttgaaaattcactactttctagctttaacttcgcattttggtacaaataatatgaattttttaggctattacaaggattatcatctggatagatattggttatcctattgctatactgttcatcaggaaagaaatagtaaccatctccatttatgaaaagatcatctaaaaaatcctgcgttttattcgttatatcatattcataatcagcacattgaatatattttttctcatgtacacgtacataacgtaccattccactcggcaaaggtttaagccaagtgtgtttatcgtattcttcatatttctcacgagacttcaacacatatccgaaaattgcgcttataccatctacacattttactgtaattttattatcatgcttgtatcttaccctacttacttcattatttccgcaatattcatgtagtttcaagattttcccattttggcattgctcgtacaaatagaagtcatgactattaacatcaattttaggccttacaatatcaacattaaaatcacgcataattctattatcaataaggttacctttttctgaagtcattacatcataaaatcttatctccattgtaccatttttatgttcacttaactttagtttagacaatacaggaataggaacacatttagtcataaaattcccttgatcataataactagcacatattagattatgtcctgacctatatattctaaactcatacaactttccagaaaatgcaactttataatctccccctattacatcattctcaaataagaaaaagtctcgtttatacaaacttccattatctactattataagtctaatacctggtttaaagaatgtctggcgcgaaaactctactggtacaaatcttatgctatttttctcttcaagtaataaaggacaaaataccataggaagtggttttgaagatattttttcacacattatactagtctcacactttgtaccccattctgattggttaactggcaaattttcacaagaatatacttgacacatacacagctttggatgcataaaatcactttcatcaatataagcgatacagtacattgaagatgatcctacacttttacactcccctgcattaacagtagtttcaaaaaaaagatttgccaattttatcttatcattacaaaaacgtagagatttataactcagactaggttttgcattaaaaatctcttcatatccaaacacacatgtagtacccacacaaaatgtcaatataaatatatataagactccttttacaatattaaaaatatgcctaaacataaatatatatacttaaatagaaaagaaaattatagtaatgcttaatatgttaacataaatatttattcatattaaccatattttataataaatataatatataattaattatttatttaagtttcttaaaaagaagactaatataatgaagtaatttacttgtaataaacttgatatacaacaccattaacttacttctagatagttagaaatactttcgcatcaggtaatgccaaacacaactattacctagtacaacacataaggttctgagcacattaacccttatacaaattcacatatttacttagtgctacagctacttttttgcttgaattggtgttgcattcttcaccgatgaactttttactactttcaccatagtcttattagattgtttgtctacttgttctctaacttcctgcggcaacctatagtaacctagtatttgccatatagttctaccaaccttccaacaaacaggatttatatctagactaaaaacatctttaaccttagcacggtgatggtctcttatatcactataacaacacgtataatcaaaaacctcactactactgctactcttactataacatgataacgcaagattttcactagctatacatttagtcatttttccattatgataacaacaatggttatcatttggacatgacactttaatactttcacctattttactattatattttacatctacagcactactaggcaaacaagcatcagaactctcaactttatctctaactaatttataactatttggaccatcaaaagttccacctttagaataaatacataaagacactaaacaccctttattttttaccttatctgtagtatcaatacaaaacgttttctcttcaggataataagcatactgtagctctactcctttggtttcctctaaattcaaatttatatcaagttgttccttagataacggcttattatttttccgctgtgattttgctaatgttaaaaaaccatcagaagatccaaagccagcatatttttttgcaaaaacacgtgttttttcatcttttaatccataactttccaatgtattatagttatatgatttcacatctgtatttatttttaaattctctatccttatttcacttttaaatggataattcattctctcttgaaccaacattcccatagatacactatcgttattctgtataggataagtaccaatagttttcagatattgaatattgttcccaatactcaaataggatacctgtttttttacactattatcaccttctatagatttagtcaccttctcaaaattctcaactttttctgttttatgtttctgtgtttcagctgtattagaaatcggaggtaaactagtcagtaattctttaccaccatcatcaaaagtttccctaagttctataggcaaagtactgtaattaaacattttcagtatattaacacctttttgtctccaacaaatatctttacgatgctctgtatcttgtatattatgataacaacatacatatttatcctccgacatctttaaatggctcatcctatttctatagcataacaaactcatattttcatgttcccaattttgccaacattttatacgattaacacgcagtccacctgtagcataagtataatctgcattatcaaaattagacatataaccagtaactagagcttggtgattgtcataacaatatttactatcactcacacgttttatagtcatcttatctcctgcagcaaaaatattcacaaaaagatgatgctttctttcaacaagaggttcacatttttcaccaaacatagtaacaggagatctaaacttcatatattcattatctgcagaatatatacaaactgactttaaacatccaccacgaccatttacacatagtgaatttttatttttattataaatatagcttgcacttttttcattctgtactcgtttagtagtattaccactccacatctcacacgttagtcttactaacccatctgcaccttcttgaattgatttactgatattagcacatcctccagaaccaggatactgatttgggttcttttcaaatgcattagctggtcctgaacaatcattactatttaatctaatagtaccagcaggaaactgaggatctccccatggaataaatctataatactgtaaccatacaggcctttgtctagaaaaatccataccagtagcagacctataatgcattacaatatcatcattaataaacgagtgattcttttgacactcattatgagtacatccacgagctacaaatgaaacattacaattactattaaaactaccagagtcacatagagccactactgtatcttcaccatattctcctggatagctgcctccttctccaacatatattactaattttttcccttttagtttaccattattagttcctaatataccaagagtataatgagcaggagccccagaataagctttaccatcacttatatatccagcttgacctcctccccaagcttcaacttttataaaatcacactgatgataattacctatttcgtatacatattgttttgtcttggtaccatctatatgtttctttaccctatattcatatttagggaaatgatcgacacacattttttcaaaatacaagtttctctctactaatccatctaaaactccttcattttgtagaataaaatccagattttttaattcactcctatttctatttggaccaaaagtttgaaaatcatcacttgtataactatataaacaactcttactatattctctgtcatcagaagaatattccaatttcccaaaaatacactccttagcatctttaacatttttaagataggttggaacatacaaatataattcactattcccacataaattttgttttgtatttcccttatatggagcaatacgataccctaccctaggaatagtatagtgatcaccacgaactttaatagacgttacaaaagatctcatatttatattatcaagatcatagctcatactatcatcacatgggtaatataccccaccatcatatatatgacgtactaacttcttcttatttaaccttaaccaaaaatatctatgtcctccaatagtttggtcatatctttttatataatacccttttcccgtataatttaatcctgacagacatgttatattattaaatacctccttagttgcaattttctctacagtcttagtacattcaatgcgatctccccgcacgttcccatcaacacattcagttcttgtttcaaattcatgagttttcaagttcatctcaggctgaattagatcaacagatttaccaaatacagcccttaactcttctgctgtcatttccttgacttgttctttataatcacgaccagtagcactatttagattgccttcaactacacttttcaccttgacttcagcaacaaatatttgatctttttttcttattttaaacacaggacgccttaacgctggtatcggtaaacattgctttatacattgtcctctactattataataaacacacaagccatccataccacttctatgcatcccataatacataacaccataatctgccagactacgattacttttaccatttgccttagacatcatagacttgaaatctacatacaatgattcaccagcttctggcacaagtttcaaacctttagaaggatgcataagaaataatttaggctcaaaaaatgactgcatataaaatggtacaatacgaaaatccagaactggtatttccttgaatatagtgtcacagaaaggataaggatttttatcaatttgatctaaagtataaaatgtactaccatcaacacatgcagataaactaacataagggaaaacaacacacaaataaaatattacaagagctatcttttttaacacacactttaccattgaatagaagacatacacttattcaagtatatatctaaaattgtatattacacaattaactatctacatggttgtagacctatctacccaaaatacaatcaatccagcgctattcagtgaaaaatattctataattaaaaattacatcatattttaggatatatacagttaattagtaaattgaagtaccgctaataaagcaagtaactacttcaattaaaccactcaaactttcctataataacaaaatttcaatctacacaccttgcacactattaaaattttctttttccctattgttaataaattgttgtatataacattacacatgctatttacagtagaaactcttatatatagactaaaaattaatcaacagtttttaaaatatataatccacatttataaaactctgttaactattaattaatatataaaaagtggtaactgcttaaactacaacaaaactacaagtgtgaatgatataggtaacaacattcccttataatatacttaatcaaacgcaacaatgttaaactaaaatattactacaactatggataataacattatataacttattttataaagaaatttgatgaaaattttcagtacattatttttacaaatcagcaaactttataaaatagctatttgtattgaaacacacaccttatgctatattaaccaactacataaaatggatgattacttctcattaacactattgctacaattctacagaatacatataacaacctttgataactcttacaaaaaaatctcgataaattacaatgttacttcttattattcctataaatcagcaaaccctataaaatacagctacattacatatataaatggataatcagtattattgctacagttctgcaaaatacagataataacctttgataactcttacaaaaaatcctgagaaaattacaatgttacttcttattattcctataaatcagcaaaccctataaaatacagctacattacaacataaatggataattagtattattgctacagttctgcaaaatacagataataacctttgataactcttacaaaaaatcctgagaaaattacaatgttacttcttattattcctataaatcagcaaaacctataaaatacagttacattacaacataaatggataattagtattattgctacaattctacagaatacatataacaacctttgataactcttacaaaaaatcctgagaaaattacaatgttacttcttattattcctataaatcagcaaaacctataaaatacagttacattacaacataaatggataattagtattattgctacaattctacagaatacatataacaacctttgataactcttacaaaaaaatcctgataaaatttacaatgttacttcttattattcctataaatcagcaaaccttataaaatagctacatcacatattaattttatacgtactttatagacgataacattttcatatctctaacaccacttataagtatctattgacaaatagtactgcttttcaactttcactaaacttatccatactcttatgaaattttagtatatgtttttatctataaaattccattcattgttttaacaagtagggtaattttctaatattctaatccccttccagcattaattttatcaaaggctccatatcatcattaaatgaagcaaggcacgaaatacaagcccacaaagcaacgacactagctctataattactatattctccatatttcatatgactaacacttcgttgcaattgtgacacagtaccataaggcaaacaatgagcagttcgtgacaatgaagaacgcacatctgccaacatagagtttacctgagtagtactaaccaataaatcagacattgcatagtttaacatcattacattaatcaataaaagcacttcttgttgaccatttgtaatgcctaaatccctaaagacatcatagttagaataaatttcctgctttaatttatgaagctcattgcttatttctcgtaatgtcatatcggaacattctccacccaaaccccctcttaatacacagtgcattacataatcatacactcgttgtttatatgtatacaaagattgcataccagagaacttacgagcaaaatccccagtagttatttttcttataaaattgtatacttttaaaggcaatttttcactatatcgattcatagatgtaaaaaatactctttctgcacttgtacattttccccatgctcctatttcaaacaacaacccagcaaaagattgataacgtttaaaaagccattttgacttagaagaagcatatgatatataagaccacaacgcgattatatcagttctatgaacaccatgtactccatattccatattattagcatcttgctgcaacttaataatttcatcaactggaaaataattttgagcaaaagatattttaaaagttattttgtatcttataccttgagacaaactacgaccattatttgcattattagaactagcattacgatgcccaccaactaatgacaacaattccttcagttgactattatcaatttttatttccgatactaataaattgaatatgactgcatcaatacttaaaaatattgcctcttgactgcttgtaatccctacatcagtgaaaattttatatatatctggattattcaaaaggtctgcaatgttagaagataactgccttacatttgataaaagatttccaagataagaatatacatcatttatgtttgatactcgtccattaacaatattagccacagagtcaacctgaaatacacttccaacacgcaatacatttctcaactcatttgtatagttcattaacgcaattcctaattctggaaataacgacattttctcacagaaatttttctcacttattttctttaggaaatctcgtaaacttaaaggcaatttatctccataagtattcaacttattaaataaatcaaccacatcattatcacagcctttcagatctataaatttcaagtctatccctaatagtaattttacaaaagattcacattttttaatactccatccagattcagaagacatatatgatatataagaccacaatgcaattatatcagctctgtgaacaccatagtttccatattccatgttattagcattttgctgtagcatcaaaataccattaccaggatatcgattctgatcaatcgtaacctgttgtatctgacctgaacctttactacgttccaaccttatattattcaaagcaagactattatcataaatcaacaataacaaattcttcagttttttctgatcaatttttatttctgataccagtgaattaaatatgactgcatcaaaagctaaagatatttcttctttactgctagtaatacctgcatcagtaaaaattttatatatctctgggttatttaaaagatttgtaatgttagaagataattctcctacatctgaccaaatatttgcagcatgagaatataccttttctatatttgataacttccctctatgagcatagtttagatcatataaagaactgaaatagaacaaattacctccacgtaattcattaagtaaattttcctcatatttcactagtgaagtttctaacgctgcaaaccttgatattttcttacaaacactctctttacttattttatctaagaagtcttgcagcaccgcaggtaatttacttttgtacttgtttaacttatcaaataaataacgtaaattatcattacattttcttatcttcacagatgtcagatcttctgccaacagtaatttaacaaaagatttaaaatcttcaatattccattcaaaagaattgtatgccatgtaagaccacaatgtaactatattagctctatgatcaccatatttcccatacttcatattactagcatcttgtcgtaactccacaatagtatcataaggaaaattatcaagagcctgtgatgatataggatctaacaacgataacgtactagttatatcagaattacccacatttaaatcagacattacataatttaacattactgcatcaattaataacgctatttcttttctattacttgcaatacctatatcagtaaaaacttcataattaagatcaaccgcatcctgtaacttcttcgccatagatcctagactgctacgccacttactttccagacaacgcttatccgtattctttaatgcacagtcaatggcataatttgacaactctacaccatatgaattcaataattccatcttagagaatgtattacaaaaatctccagtagctattttttttataaaatcttgtatctgtgaaggcaatctttcactatacttacctatagattcaaacaatctgatatgtgtatcactacagtttccccacttcataaatttattcagatccattcctagcatcaattcaacaaaaggggctgcataaagctcaaaaagttgtctatcagacttaaagaaagtatacatccaagaaactacaatgttgttctttttatgcccttcttcatctgtaataacacttctatgtatcatattaataaaatttctatatcgtcttacaaattccggatctttcaactccacactaaaccactgttctggcttttcagtagttacattaaacatcattgcttcattgtcagacaatttatcataatcctcatcatgttttgaaagatcatagtcaaattcattatcagaaacataataatttaacaaacctgaaggtggatttgatatattgacaccaaaattaaaattcagtacatcaaggtataaaagtaatgtttcaggagactcattaatccctaacttagctaacattgctttaacttctgtattatttaattcagtaaatagctccttacgaagacctgataaattatgacctaatatatctccaccaaccaatatcttatcaattgcaataaaatatttactcatactggatattaaatttggaaaactttttgattgcctacaaaagctaaccttacttattttctgcaaaaattcctttactacatttggtataccagatgttgacttgtgcattttttctattaatgtaactaaaaaatcactgcatgcattttcatctattaaacttattttacctacattacctgaccatttttcacaagttattctgaccataccattagcaccttcttgggcacaattataaacactagaacatccaccagccccccagtatttattagaatttttctccaaaatattactatcacataaacactctttatctcctttacgtaacttaccataaggcatatccggactttgataaggtactaatatttcactttctcctgaattctgtaatccaggagcaaatctataatgtactagattgtcaatcccttcggaactatcttgtaaataattaccgccttcatcaccaccatgcgctattattttcactaagcaattcttatcatcatcatcacacaactttacagtggtatccccaccagaattacttaaagaattcgctcctttacctccatcaccaatatcaattatcaattttttattaactacatttttatcaaaccttaacaaccccataacataattaccagctttaccagacctaccagaccttgatatcccagatgctcctcctccccatgcttctatttttaaaaaatcacattctgtatttttctggtcaatacccaatttataagaatctggtaatatcttccttactaaaactcttttcttatattcataagaagggaaattactgacacacataccttgtaagattggattcagaggtacaattttttccaattcatcattttcatgaaagaaatatgtaaaatcatcatcactcatataaagtgaactacatccttttatcttctttgttccataatccaattcaaccatattcttacaagatacctgtccacctttttcatataatctgttattttcatacctatatagcatactgtcctgacacggagcatttttaggattgtagtggcctccaatatcaaaaaatgcatcttgccttattctagtaattttatttagctgttcttgtgtcatacttttaatatctattgcaaatttctgatcacattgcacatatctttcaacatcctttccagtatcagttttaccaacaacaactccataacccaatagcattttatcatgcatgcttaaccacaagtctctatgattctttttaatagaatacttcataggaacaaaaggcatatcaacaacacatgtaacattactgttattatcatgcacgtatccaagtctttgccctattccatttacacattgattctcattctcaacaattttcccatcttcacattcataccgactgagcaaagtgtaattattaaaatcaattttaggctttattacagaaaaatacatatcaagatcttgtgtacctggcaacatatcaacactacaactagataatccctgacaatcttgatattgtatattaacaccattagcattagaagttactttaggacgcatcaatcctggagaaggaacacatacttttttccctttttcaccattattactatattccgcacatactgtatcataaccagctttataaacttgaaattcataaggaattccagcatgtgaaatattataagaagttttatcacctatcttatgagatttcacatataactcctttgtataagggttaccagatcctgaataaatatgtattctaacaccaggtctaaaaaaagtttgctgagaaaatcttaaaggagtaatagagactatactagatgcgtccaatatgctacagaatggtggaggattaattgctacggttacctttttacaacgtatactttttttatcacatgaatttctttcaggtttaacattacactttcctacaaaacatatacagacctttgaactagcgttttcattttctaaaaatgctatagcactgacaggatcataaattatactaccagcatatagaactttacaaccacctataggtaaactatgaaatgtcacctttccccaataagaagacagctgcataaacattacatcatggtcatcaaatgtacgatcttccctattaaaaggtatatctaacccagaaacatttagattttctacatcctgatattgcccttttacatattgcataaaagacatatatctataactatcatgtgaagcaaatcttatcataacactatcaagattaccttccgtattatcgacaggtttataatagttatcaaaatgaagaccatagtaagtgttataatgtacattagcataatctctgagaacatgtatattgatcttagcatgtaaaagtgcacgtggataaacgaaagataataaaacaattaagtataagcctatatttttgtaacaccataccttcataaacacacttactaatcgttaataaaaaaccagcacaaaaatcatccgcactcttaagagatatctccaaacaagaaacaatctatatgaaatttccttcaatataggatagatcatgatttttatataataatgaaagttttcctctaaagcataaattatagatttgactatcataattattatagggaatatacagaaaattaataatatatatacatttcatctgcatattaccatataaaacacaataaatctattaatagaaaatgataaatatgatgtatcagtaattgttgaataaaaatttaacaacactttatgaagtttcttgtataatagacgataaaacagaataacagaataattatcctatatctgtgcataaaacatttgaatcaatatatggaacagaaattatattttacaatacatgatatgctatatacaaaatattatgattaatcttcaaattcttcatactcaacagaaatccatcaactactttaaatttattaaagcacagtttcccaaaattgaaaaaaataagtaaattttctaacttccatttttttatcacaaacaagcttgtgatcaacaacttctacaaatgttactaatattatgttaagtccatttacattgcataaatttcatacagtgtaaaattttaagctccacatttcttataaaatgcaggcagccattctcttacattatccccatgactactaatagattcatacatataccgaattgtattcttattagcagaaagaacattagtttctggtatatttggcaaattgaaagacaatactactgaatcattatcctgctttacgaaaaaatatccttcctgagatggcatttgaaacatagtattacattctgactttgatagattaaatgccctcatatacattttattagttgatactgaatttggcatgaaaacttgtgtttcaacatgctgattaaacctacaaatgatattactggaaataatagctggaatgttttcaccagcaaatacaacaacaacatttaatttgttcatcatttcaatccactcatcaaattcctgatcactagtaaaaacataatccaaaatccatgcttcatctattactaaaaccgtaggagacccatcaagataattaattaaagcatgcaaaaagtaataaacaataacagaagcacattgaggtttagagaacaaaataccaatattcaaccctaaaacttttgctgcccaatcaatattagcatcttcctttagtaaatgcgcaaactccccattatttaaccattgactagcattggtacccagtgtactgacatggtcagcaatactatttatagttctagactcaagaggcaacgtaaaaagatcattaactattctatctattgcactattaacttcctcagttatgtttttaacattcaacattctttgcaaaacaccagtaacgattctacgattaagtgcagtatcttcaacttgaaagaaattaaacgacatttcctgataatcacgcctatggtctgctctataatactgaccacccatagccttaacaaaaacaatagacttaccagtataatctagcaagacaattcgtgcattcaactgcatagattctgacaataaaaagttcagtaacatagtaactgaagattgaggactaccaaccattaaagtgtgtcctttatcaaacacatgaaaactaaagaaataaggtttacccttatttgaaaaaaacatagtaattgcttgtccccacttgtttccttgaagtgctcctgaagggaaataatgcaacaacgaaaatgcacaagcatattttattaacgtatacctaaagtttaaaatataagaaaaattgccaggtaaatgtgcccaaaaatcatcttccatgctcaaatcacacctgacacaaataataccaagtgaagacaatgaattaacagccctatctatattattatgaagctgtggtaaagtatctgacattattacaaagtttattttgcgttcgcagaaacttaaattagagtttggatcaactgatacgaaatcatctatattggataactttctcaactgaaaatcattgctacattctaaaaatgtagcttgcttttgaaaaagctttaatgcattcttactttttgcaaactttataatttcaactacgataaatccataatcctgctgtagacattcatctaccgcatctaatggagaatcttgataatctttaattgctaatattgcaccaaatctttggttattatcacatgaaattttaaatgtattaaatcccatactaatactacaatgactacatataccagaaatatctaccatatcaaggaaacattctttatgatgcatcatagttaaataatacaaaaactctatcaactccgatcttactttttctttatcaattactatcaatcctaactttctgacttcaaactttttcaaattttctaaaatacttgcagtgaccttatttaatctgtctattttattttttaaaaaatctttatgcttattttttacataggagaatgacagagcacctaacactcctttcatactttcaggtaagtgattagtaaccactgctatatataactcattaatataagtcacacgttgacctatattattaagatgagcactacctaaagcatcagaaacatcgtttatactttttcttgcaaaatcaaacttatgtggtttccttacagtataaatccaaaaagaaacttctggaacttcaacactattaactatactattacgcactactgttcttaaatctttatcattaacataatgagtaagtacataatcctctatctttattatttgtacaagttcaccatctttattcaatattgtattctcatcataatgacaagctgcaggaataaaatctcctttactagaggtattatctcgtctttttctagaaaaattattcatatcagaagaatggccgatcatttctttcacaaaagacatacaggaaacccttatttaaccctataacatttatataaatatccataagtaaaattaacatctatataggataatatctgctttaatcatcattatctaaatacaaaattaatattttctttatgctacaattaaataaacaattaatgaactaccctattatgaaatttacaatgcaaaaatcaagaatctcagactcatttttacatagatggcattcacaaatttcaatccagcattatacaaaaaacaaaatcaactctacatttaaatctatattagtactacaagttgaataaatacaataacactctacttgaataatacaaatttaaactagcattagccaataaatattcaccgtcttaacataaaaatcacttactaagaaacacatataaaacacggactattagagaaaaaaacttatgtgatatacaaaaatataacagtactaagatgtaaaattgcatttagaattccgaagtaatccaatctaaaaacgatgtaattaagtaagcaatagaaaattcaatatataaacacccaaatattcccacaattcattgattttctaaactattcactataatcaaaattacttatctactcatctatgaagaacaagcttaccaccaattcacaaacaaaactacctaatgacaattaaaaattactattggattatactgattttttaatcttgagaatactaacagctaggtaatccaagtattactgcttataacaataaaaataccagttaaatacttaaaacccatatataatactgtatcatatacaaattaagcagcaacttgaagccttaaattattgcaagaatacctgagtaaagctaagaacgaaaattacatagatcacaatattccataatcactgtattcttaactttcaaaacccatcacttaacctggctacttggcgttactaaagcagaacaatcttttacattagtcatattattattcaccccttcaacaaacttagtaattaattttcctgctccaaaaaatatcgctgtaaatacaaccaacattactattgctggccatggcaattttccaaatattgccataatgcttgagccaagtattacccctgtcatgattggcaatcccaacttttgcacaaactgtataacattacatataactttacttacatcatctgaatcaccagtaccagcttgctcgttagcatatgcacctgagtaacacaacggtgcaacaccaacaaaccctactattataaaaaacactaaaacaatttttaacataaggctctcatttatttttttgatggagtagtactacaatctgccccactagtcatattattattaattccactgacaaacttactaactaatttacctgcaccaaaaaatattgctgtaaatacaactaacattactattgctggccatggtaaccttccaaatattgccataatacttgaaccaagtattacccctgtcatgattggcaatcccaacttttgcacaaactgtataacattacatataactctacttacatcatctgaattatcagtatcagcttgcttgctagcatgtgcacctgaataacacaacagtgcaacgccaacaaacctactattataaaaacactaaaacaatctttaacataaaggctctcacgatgattatttagtacaatctgctccactagtcatattattactaactccattaacaaacttactaaccaatttacctgcaccaaaaaatattgctgtgaatacaactaacatcactattgctggccatggcaaccttccaaatattgccataatacttgaaccaaggattacccctgtcatgattggcaatcctaacttttgcacaaactttataacattacatataactttactcacatcatcatcctgactaaccgtgctagtactactattattatttgctgcagcactagaaaagtttaatgacataacacctataaatcccacaattacaagaaatacaaaaacagcctttaacatataacttataccttacatgaattttcgaaacacctgaacaattctatatatgacataccttcaactagtaatacattaccaatcacacatgttcagtaagctaatagcttacctcgcaaatatgtactgtaatgctactcatactaattcactgatcttagtaatgcctaagcctaaatattctaactaccaatataaacatcagtaacttaaacactaaagcaatataccatatataattaaccactattgatcacagccacaatttatgcttctctcacaaactctatagtagtgctattaaattgcatatttgacatgctttcttaatcttattgttcccaacaataaattagactacgcaattttcaattcacgtttgcaaaaatatcatgggtaaaacgtttatactaatcattataaatgcagtatatttactacaattttcctgatatctactttataaacatatccattatacactattaataacacactcatagtttttgaaacaaaaagcgttaaaaatcatagtgattataaaaagttttctatctaattttatacatcataaccccatcaacaaattcccctgctatcaaaataacaacaatgttgatatactaagaatttacacactctatctcaacctactgttgtataagttaacctaagtacaacacaaaataattaacatattgtaaattaatgatgcctttttatatgtgaatgtagtataagcatttattataaattggattagttgtcgttgtaaaaagcgatcttacaaaattagaaaataaagtaatgtaaaatacggaatctaaagttaagatttgatatgcaatctcatgacagaattatataaaaactttacaacaattcattgaatgctgagatcctaatagacatattacattgataaaatactgcatcttcttttattaaaaaaccagcaataaacccaagacaaactgtactttcaccactatcgctaaaatttcccctacaattgatcttaagttgtatatttaatcaataccctagaaattgctataaatcttttaaaatagggtacatacgtttaattaaaaaaaaaatgttactttagaatatattaaatttcttctactgtattaatctaaaactcattttgataaatatgtgacattgacaaaatactgcaccttcttttattaaaaccagcaataaatctaagacaaactgtactttcaccactattgctaaaatttcccctacaactgatcttagttgtatatttaacaataccctagaaattgccataaatcttttaaaatagggtacacacgtttaatttaaaaaaaatgttactttaagaatatattaaatttattgtatcatattaatctaaaattcatattctcacaaatgttacgtagaacatgtaatacgttataaccgctcagacattgcttatatatatctacgccttaactataacagaatctcttaactaaatgacacaaatcaccgcttgagaaaacaagaaaataattacaaagtattacacaaacacagtgacattaaaatttatacatacaaaataatctatccagtcattagctagataatcaaactgacatgcataactattagtgcacaataaactgtatcacaagatacaaaactaaaagtcagttataactaaagcagccacgtaaatattaacatatcgacaacttttagtataactgacttgttcaaatttattacatgtattcatctactaacttaatctataaagaattttcagaaataaagttactttatatcagaaacaacagatacaattaaacaaaaaaatacatcacattataaaccaattaaggaccttttgatattgaactacaatcaaacttatcagctgaaagttctgttattccaccagcaaatttagatatcagcttacctgccccaaagaatatagctgtaaacacaactaacattactattgctggccatggtagcctaccaaatattgccataacacttgaaccaaggattacccctgtcatgattggcaaccccaatttttgcacaaacacaacaacattacatatcaccttagtaactgtatcatctcctgcttgaccaccagtattagcatcacttacatttggtgctacagaaaacattaagagcagcaaaaatagaagagctctacctataaaatacttacttatattatacaccattattaatccctcacaaatttatgaacaacaatatcaacaaaacactctataatgtttattaaataaataaaagacttttcctaaaaattagtttatataacaatccattgtctgttttttcataaaaaataaaaacataactaggatatatactgatacaacacttacacataaaaactgctgctaacctaacttcactaaaaaatcttatcattgaaaatgtcatgcaacactttttcacttccctatacatttaaatatttaaaaagtcaattattattaatagtttagagaatcagactcttttactaacatttatacgaataaaaattaatatattttaattttattaagtatatttctagcattttagttaatactatctttataaaaaatattaatacaaacaattattatccaagtataccaattatcagtaaacagtgtatcagctcacaataaatactatattaaaaatacttaattaaaagatataagatattaatataaataaaaaatttatttaaagaatatcaaattattaatatcaacttcctaatatgttaatcactaaaaaaataaactttgacatacatgagtattttcaatagatttttaagatattgatgtataatgagggttttcttgatttttcaagagcttaatattgtggttttggtattttaatgttaacaacagttatgttttgttatatattagatacggtacagtgctgaaaatgagtaatgcatttagttaaataggtggaatagcttatgtttgatgattatgatccttggaatagtaataacaaagaagaccacaaatctaaaggatataaaaattccaatgatattaataaagttattcactatttcaacaatacatttggttcatttttaaaaaacaagaaaggcattcgacctaataatcatggaaaaacacaatttattatcgcatttttagtcatgatgcttctatacatggggtctgggttttacatagtcgaacctgaagaagaagctgtacaactactatttggtaaatatcatgacactgtaggtcccgggttgcgttattatctcccatcccctattggacaggtaattaagttaaaagttaaaacagttaacagggaagaaataggttctaggttttattcagatagcacttcaggccatggcgaaggtgttatgttaactggagatgaaaacatcgttaacataaactttgatgttcattggcgcatcaacaatgcatacaactacttgtttaaagtcagagataaccaagtaggagatacagtaaaaaatgcagctgaaagtgcaatgcgtgaagttattggaaaaagctctatatcttttgcaattgaggggaaaggaagagccataatatcacaagaaactaagacattactacagcatattctagatcaatataatatgggagttgaaattttatcaattcagctaaaaaaagttgatcctccagaaaaagtgatcaattcttttagagatgtacagagtgcaagagctgataaagaaaagttgattaacgaggcatatgcataccgtaatcaagtactgccaaaagctaaaggtgaggctataaaaattaaactagatgcagaagcatacgaaagtgaagtagttaacgcagctgaaggtaatacaaaaaggttcattgctctctataaagaatacgtatatcaacctgatgcaatgagaaatcgtttatatttagaaacaatggaagaaatattaaataaaaatgataaggtagttgtcagcgatgatctgaaaggtatgctttcttacttcccgttagcagatcctagaaatagtaggtaagtttatgagtaaatcatttaagttcatattagggtttttaactatcgcaacagttatcgtatcattaaactccatgtttattgtcgatgaagcacatcaatcaatagtcctacaatttggacgcgtagtaaaacagatacacaatagcggattatattttaaagtaccttttatacagaaggttgtgtatgttgacaaaagaattatcgatattagttctgactcaagagaagttatcgctgctgatcaaaagagatttatcgttgattcttatgcaaaatacaagattgtagatgccgtcaaattttatcaaacagtcagaaatgaaacaggattaaagaatagattaagttctatcatcgaatcaaacatccgtgaaaaaataggaaatgtatcacttattaattttctaaatgaagcaagatcagaagttatgtcagtgatacaagaaggcgttagcaaagagtcccaaaaatttggcatagaaatgatagacgtcagaattaagcgtgcagatctaccagaagaaaatagcatagctatatttagacgtatgcaaacagatagagaaaaagaagcaaaagaaatcagagcagaaggagaagcagcgtcacagcgcattaaagctgatgcagaccttcaaactcgtattatcatcgcaaatgcgatcaaagaagcacaaatcattcgagggaatggagatgctaaagcttcaaaaatttacaatgaagctttaaaatctgatccaaatttctttagtttttatagaacaatgcaagcatataagcatgctttcaatgggaaaaatacaagaattatcttatcacctaataatgattttattaatttgtttaataaagaaagaggtaaataattaatgaaaagatttctattactaatattagtactaatattggcaaatgttcctataggtagttttgctgatcagaaagcagaacaatatgatccaaggtcaggcttttctaaattaatcaaagaatctacaccagcagtagttaatatcagtatagtacatgatttaatacaggaacaatttcctttaataactctcgaagaacttttaaggaatatattagaaggcaagccagtaaaaaaagacataccacaagaagtattaagcgcagggtcgggatttgttgtagatgaatcaggtattatcgtcaccaactatcatgttgtacacaatgcaaaagaagtttatgtcacatttagtgacaacaagtcaattcctgctaagattttaggagttgacccacaaacagacctagcagtgttaaaagttgaagttaatgaaaaacttccttatctagaatttggagattctgacaagactatggttggagactgggtagttgccataggtaacccatttggtcttggtggttctgcaagtattggtattatatctgcacgcgcaagagatcttaacattggcacagcaacagaatttttacaaactgatgctgcaattaataagggtaactctggtggtcctctatttaatatagatggtaaagtaattggtattaacacagcaatattatctacacaaaaaggtggtggtaacataggagttggatttgctatcccatcaaataatgctgtttctataataaaagttttatcccaagggaaaaaagtagaacatggttggctcggtgtagtgatgcaaccgataactgaagaactagtagaaccattacaactaaaagaagtgggtggagctttaattactaatgtagtcaaaggtagtccagcaagtaaagcaaacttgcttccaggggatattatacttgagtttaatggtactaagattaattcaatatcacaactacatcaattagtactaagatcagaagcagacaatgaagtaaaattacttgtgtcacgtaatggtagtattataagtatactagtcaaaatagggaaatttgagaatcctgatatttcagaaaacggaatgcctaaggatgctatccaatccccggagttagggttaacagtaggtagtgtacaacgcaataacatatataataatattgaggaagaagaagcaaaaggagtggtgatattagatatagatagtacaagtaatgcttcaaccagaaatataagaaaaggcgatataatattacaaatcaatcaatcaccagtaaataatctcgaagattttaaaaatgttatgaaaaaagtacgtaaaaataaatctgtagcattgttaatcagtagggataatatatcagcttttgtgactgtcaagctgaagcagtaggatgaaaactaaaatagcatatatatatttttttatagtgtattttgtcagtatacatgcgtattcaactgaaacaataaaagaagaattactatcttattttagtgctatacattcttttaaagcagagtttgttcaaacaagctctgctaataacgatattcagcatggaatggtatttatgaaaaaacctggattattaaaatgggattattatccacctactccagcttccattataatgcacggtagaaccatttcttactatgataaggaactagaagaatactcttattcaattattaataatcctattattaatttattaagttctgatattaaagatataaaagatataatctttctaaataccagtacaaccgacagtaaaaaagtgattactatacaagatcaaaaaacagcactactagcagatataattttcaatacaaatcctataacaattgttggattaaatatagcaagtccagattctataacttatattaagttttacaacattcaaaataatattactataaaggatacagaatttaaacatagtacatcttactacaattaaaataaaatcatgatagaaagtatatcaaaaatcataaaatataactttaaaaatccccaattattaaatgaggcattgacacatcctagtctagtatcaaaagataccttaaaatttaactatgaaagactagaattcctaggggatgcagtattaaacatagtaatatccgaaatgctattcaatattttccctaaagatacagaaggtaacctcgctaaaaagaagacagcattagtttgtggcaataagttagtagaagttgcacagtctataaatctcggacaatttatcatgatgtcagatggtgaaagagcgtgtggtggtataaataatttccgtaatttagaaaatgcattagaagctttaataggtgcaatataccttgacggaggatttacagcagcacaagactttatatacttattttgggaacattctgcaacacatatgaatgtccctccacaagatgcaaaaactatactgcaagaattggtacaaggaaaaaggttaccagctcctgcatatcacaccatagataaatctggaccagatcacaaccctacatttacagtagaagtaagaattccatcatatcaagcaatacaagcaactggtcataataaaaaactcgctgaacaaaaagcagcaagtttaatgttaaatcaaattcataacaaaacaaaatgacaccaagaataaaaaatactatttacatattaataacaataatattatccatggtatgtttagtatatgcttctgtaccattatatagcatattttgtaaagttacaggttacggaggaacagttagaaaaagtaatattttatcaagttccaaaacaggaaatactactattaaagttagattcaatgcagatattaataaacaattgccatggaaattttatccagaattaccatatgtatttgtaaaaccaggcgaacaaaagttaattttttaccgagcagaaaatttatctgataaagacatttcaggaatggctgtatataatgttactcctcataaagcaggaaaatattttaacaaagttgcatgtttttgctttagcaaacaaaccctatttccttatcaaaaaactgttatgcctgtgtcattttttatagaccctgcaatagaaaccgatcctgaaactgctgatgtgaaattaataactctttcatacgtatttttcaaatacaaagaataaatccctatacccatatgtaataaacttctggttgcctgtataaatatgtagataataggcctttatcatcaaatctaaccactatcaaatgacacaaactttacctataactacctttgtgatttatagtaacaagataacacgttcttcagctactaactcttcctcacatctaatgaatctaatatcattaaaaattaataatatacatctcaacttaagtaatacacactactacaaatcaatctattataattctaaataaaatattaactcgctataaattctttttacaataaaaaatgtatcaaattaaagctgacaagtctttagttataaataattttacatgatcacttattataaagcataactaaaattaatgataattaacaacatcattatcattactctaaatttataagcataattaatgatttgataataaaaagacaataaccttaattcatttgatattctcaaattatacatataaactatcaatcaaataatcgtaaggttacagtaatggttaaattttttacttgtttttttacaatcttcttcacaatagctaatcatgctttatcttttaacattaaagttacacatgaaaagctagataatggcatggaagtatatgttatccctaatcatcgcgcacccgcagttatgcatatggtattatataaagttggtgggactgatgatccagtaggttattctggacttgcacatttttttgaacatttaatgttcagtggtacagaaaaattccctaatcttataactactctaagtgatataggcggaaacttcaatgcaagtacatctgaattttgcactatatattatgaactaataccaaaacaacatttatctcttgcaatggatattgaatcagacagaatgcaaaattttaaaattactgataaggcattaataagagagcaaaaggtagtattagaagaaagaaaaatgagagttgaaagtcaggcaaaaaacatactgcaagaagagatggaaaacacattctattataatggatatggtagaccagtagtagggtgggaacatgaaatcagcaattacaatagagaagttgctgaagcattttataaacttcactacagccctaacaacgctatattagttgtaactggagatgtcgatccacaggaaacaatcaaccttgcacaacagtactatgggaagatagaacctaatcacaaaaaatccacacgtgtttttagagcagaaccttcacacaaagcaaacattacattaacattagaagatagttcagtagaaatcccagaattatttttaatgtatcaaataccaagcggtatcgcaaataaaaactatatactcaatatgatggcagcagaaatacttggtaacggtaaattcagtttgctttacaatgatctagtaatgaataactcaatagtcacatcaataggcaccaattataactatttaactgatagtgataactacctctttatagaagccgtacctaaagatgggatctctacagaaactgtagaaaaagaaatccacaaatgtataaatagttatcttgaaaatggcatttcaccagaatatttagaaagtgcaaaacaaaaagtaaaagcacacttaacttattctcttgatggattaagctttatatcatatttctacggcatgaacttaattctaggagtaccattatcagaaattaacaatatttacgatacaatagataaaataaagattgaggatattgattccactatggaaaacatcttcttaaagaacgtaagattagctggacatttattacctaaattgggagaatagttatgaggaatacattattctacataataacattgattttttttgcatataatgcatatgcagatgatattaatatcaacataaaggaagccactattaataataacatacgctacttatatgttgaacatcacgacttaccaacaatttctttaacacttgcattcaaaaaagcaggatatgcatatgatgcttctgacaaacaaggacttgcacatttcacatcacaaatattacaagaaggatcagaaagtaatcatgctctagaatttgcaaaacaattagaaggtaaaggtatagacttaaaatttcatgtagacatagataatttctatatatctataaaaacactatcagaaaactttgaagaagctttaactttattaagtgattgcttattcaatccagtaactgacccagaaatatttcatagggtaatagcagaacaaagtgcacatgtaaaatctttatatggatctcctaaattcatagcagcaactgaaattaatcatgccatatttaaaggacacccatactctaataaaatctatggtacattaaatactattaacaacattacccaagaagatgtatcatcatacataaaaaacagttttgataaggaccaaatcgtcattagtgcagcaggagatatagattcagcaaaactatcgaatttattagataaatatatcctatcaaaattaccgtctggtaataacaaaaatactataccagatgccaccgttaacagagaacagaaactcttatatgtaagaagaaatgtaccacaaagtgtcataatgtttgctacagacacagtatcatacaatgacgaggattattatgcatccaacttattcaacaatatgctaggaggattaagccttaattcaatattgatgatagagttacgagacaaattaggactaacttaccatgctagtagcatgctagataatatgaatcatagtaacgtgttactcggcataataactactgataatactacagtaacaaaatgcatatctgtattaaaagaaattatagaaaatattaaaaataatggaattaatcaggaaacttttttaactgcaaaatctagtattactaattctttcattttatcaatgttaaacaatgataatgttgcaaatacattattaaacctacaattacgcggtctagatccaagttatataaacaaacataattcctactataaaaccctcacaatagaagaagtaaccaaagttgctaggaaaatcttatctaatgatttagtaataattgaagtgggaaaaaacaataatataaacggtaaacagatagaagctaaagaaaacatacttggctaatttattataagtatgctgttagctatataaacacagtaatcacatctactttagattaggtagtaccattcattaatatatagcaaaagcagcatactttcaacttaaagttacaattccataaacacaaaataaaataattgataaatcaataatgcttaaataactacgtacaatttattaaaaataaaaggttagtatctattaaaatcagtatactccttaattaaaaatttttagtattttacacatgtgatttttttcatagtaattatgtttcaacagaataaattactagaggttgtatttgtattcttgacaaaatcatatgaataaattaaaattctcaagtgtttagtcttaacggtattaattatgaaaaacaatccaacaggaccaataacgtctgatttttctgttcaaagattaatgttactggtgtcggtaatatcttttgcggcgttaattatgtctgctctagttgctcttaaaagtaatcaactcagttttagtaatgcatattgtatagctacaatcgcagctgctgcagtgtttatgttctgtgctacagcatcattaatatcttcttgctgcaggagaagccaaacaacaaataagtcacagatcaagaaaaattttgggcgaaaggatagtagtgcatctataatattatatacattaggtgggttatccctcatagcaacttctgtatgtgctggattgatgcttagagatcctacggtgtcattgctcccgtcatttgcacagttcatgaacaaccctctcaaatttccattagctattgcatttgctgtcagtgcagctgtattagcatgtacaattatagcacttgctctcaagcatatcatagcaccagatttacaaaatcatgttacagttataggaacttctgagatggtagatgttgcagcaagagatgagtgtgaaaatttaatgcaaacactcggattagagccatcacacttatcctctttaaatgtgatatcatttgctgatactatgcagcagcaattaccaaaataacagtagatgttaatgtttaaaatcaaccattaagtgtgtgtttcagtagacagtagttcatggtttaatcttgttgttggttttcattctttgttaatagcatctttaagtagttctttcatctatattataaagttatacaagttaaagaatgataaagttagtaagttattttgtaaaattattagctcttaccattattataatacctaagaatataaaagaatctgctaagttgaatgcaggccagtgccatttattaatatagaaatctataaaatcatagacagctccatattttactctgtctactatattccctactgaccccccaataataatagcaagaggtaatctatgtgataaacgtattactaaaaaataaaacaaaacaaacgtaattaagatggaaatactacagaaaataaggttactatacatgaaatcatgtaacataccgaagcttattccagtattccatactgtagaaaatcgcaaaaaactaaatatctctattattcttgtatctcctactaaactcattacgtaccacttactaagttgatctacaagaactaatatacatattatcaatacatattttttcataaactctgctacttggcaatacctttatcaacttaccacattaactgagtataaaaccctatatgcctatccacgtaattcagtaagttgacttataagcatatacttatacatatcttgcatcaacttttttccatttaagcaatatctctattaatctactgtactatagctaaacatttacactacttcgtcatctttgctcccaatatactttaaacttttctttacttgaataatatcctcgttaatctgctgttttaactgctcaatactactaaatttacgttcaggacgtatgaagtccaataactgaatagctacatgctgattatatatatcactatcaaaatcaaaaatatgcatttccaatataggaaaacttaaatcattaaatgtaggtctaaatccaatattaactatcccatttaaccacacattattatcatctatttttatacatgcagaatacaccccaactctaggcactaatatatgtttaatatcaacattaactgtaggaaaaccaataacgcggcccctagccaatccttttatcactttgccattaatttgatacggtctacccaaaatcttacttgctaagtctacttttccttcagacaaatactctctaatcaatgaagaagagcataatttatcatttataaaaataggatctattcttacaatttcataatcataaatatttgcataagaatataacaaatctatgttacctaaacatttatgtccaaaaaaacaactatgtcctactacaatatattttattctacaactatttactaatacatcctttataaaagcatccggagaaagctgtgcaaaactttcattaaaatcaataatatatagataatctataccatagctttgcaacaattctatcttttgctcaagatctaataacaaaaaattttgtttattacgcaaatactcagcaggatgtggagaaaatgtaataaccacagatgttatcttttctctaactgaaatattttttattgcattaattatagactgatgtcctaaatgtattccatcaaaattcccaaaagcaagaacactatttacattacctttttggttaggataaccatatattattttcataataaaattttataaaattcctatatttactttttgctattactatgatatccagaaattcagttaatcataggatacattatagtgataaaagtgaaaatatatactaaagacttctgcccttattgtactaaagcaaaggctttattcaacaaaaaaaacattccttttgaagaaattgacattacaggcaacaattctttgctagaacaaatgatacaacaatcaaacggcatgaagactgtaccccaaatatttattaatgatcaacatataggtggctgtgatgatttatataaactgtatgagtcaggtaaactagaattatagtaacagctgtacatatctgttttttagctaacattcctcctctatacaaatcaacttgaagaaattgacattacaggcaacaattctttgctagaacaaatgatacaacaatcgaacggtatgaagactgtaccccaaaatttattaatgatcaacacataggtggctgtgatgatttatataaattgtacgagtcaggcacactagaattatagtaacagctatacatatctgttttttagctaacatccctctatacaaatcaacattacacctaatttttagattataaagttgcacatgtagtttttcttataagatccaatctgcaacacattcaatgataagcttaggtttatgtgaccataaaatactaacctttcttcaattaacctttaaaacattagccctaattaatttcacacctgtttaactactatgcaacgtaacttgccagataaatcatcgtggtaagtacagaattttaatccataacgatatactaccctatgaatctgatgttgacttcccctatttccaaaatagctatacctaggtttatgtaaccataaaatactaacctttcttcacattaaccttaaaacattagccctaattaatttcacatctgtttaactactatgcaacgtaacttgccagataaatcattgtggtaagtacagaattttaatccataacgatgcactattctatgaatctgatgttgatcttcccctatttccaaaatagctacaccattctgctttaaacatctttttatgattacaaaaatttgtgaataaatttctaatcctattggcccaccatccaaagctaccattggctcatgtaattttacttccggctgtaatgtagtaattttactccttctaatatacggaggattactaactatcaaatcaaaagtatcatagcaagtgttccaagaggataatctcatctttatcctactatataatccatgatttttaaaattctgatatgcaactctataagctttaacacttttttcaatagctataccaacagcatttctataccttaataataaaattgataataaacatccactccctgtaccaaaatctcctataattaacctacgattcttacaaggatacattgcaaacacagaggaaatgatcgtttcactatctggtctaggatctaaaacatcagaattgacaataaaatccgtactccaaaattcccttttacctataatatgtgatataggtatattagtagaacgttgtttcaccattttccaaaatacttccacatcacatttattaataggcatatgtggatcaagtatagtaactaagttttcagtgttaataagatgctttattattatctctacatcacgttttggattgtctatgttataagtagataaaaaatcaacagctctattaaataaagaaattacagtatccataataaattagcatacataaggaggataatgcatattttgtggagataatgtaaatatttctactccattctcagtaacacccaaagaatgttcaaattgcgctgacaaagataaatctcgagttgtaacagtccatccatcttttttactaagtacagtatcacatcttccggcatttatcattggctctattgtaaaaaacatgccttctctaataattacaggatcatccggatcataataatgtactacattcggcgaagcatgaaataccctacctaacccatgcccacaataatcacgaacaatagaataaccatatttcttcatctctttttcaatagccaaaccaatctgattaagcttttgtccaggtatcacttgttcaatcgctacagttaatgctctatatgcagcttcacataaacgttttgctttaatcgatggctccccaacccaatacattctactagtatctccatgccaaccgtctagtataacagtgacatctatattcacaatatcaccttcttttaaaggcaaatcatcaggaataccatgacatacaacaaaatttttcgaggtacaaatagacttagggtatcccctatatccaagcggagcaggaattgcaccagcgttaataataaaatcatgacataaatcgttaagctcattgctagaaactcctggttttacatatggagtaataaaatctaacacctctgctgcaagccttccagcattatgcatatacttaaagtcttctttactatgaatagtgatacttcttcctaaatttcccatattctctataacctttaatcctagacctaaactattgtattaatactctaatgcctaatatccttatactagaaccaatacccatcattttaaacaattttaaacacttgaaataagacaaatatactgtaatgtattagagtaggcaaaaggaattattcagaaatccctatatatttaagtacactaagtagtatttcatcagctactataattcttaaattacattatttttagacataatagaacataaactttccatgagctctatattttacaagactatcttcaagaaagcatttaagtacattccataattaacaacaaccagaattatacctctaaaaacatcctactaggatcttcaatatattgctttattctaactaaaaatgtaacagcaccttgtccatcaacaattctatgatcataagataaagcaatatacatcattggtctaatttctatagtcttatcatcaattgcaacaggacgcttttgtattgaatgcatccctaaaattccagactgaggaggattaattataggagtagacagcaaagacccatacacacctccattggtgatagtaaatgttgcacctgccatatcagcaacttccaactttccttccctagcttttttccctaaagaagctaacgttgattcaagatcagcaaaagacattttatcagcatcacgtattactggaacaaccaatcccttatctgttcctactgcaatacccatgtcataataatgcttataaacaatctcattacctgatatctcagcattgattattggtagttcttttaatgctagcaccactgcctttataaagaacgacataaaaccaagcttaataccatatttcttttcaaaagtttctctatacttagcacgaagatccatcacattcttcatatcaacttcgttaaaagttgttaatatcgcagcagtattttgagattcctttaatcttgcagcaattacctgtctgatcttactcatttttacacgttcttctcttttctcttcagatacaacagataaactactaatactatttgctttagtattatcttcttcagaagcaagtttcatataatttaacacatcagattttgtaatgcgacctccaataccagaaccactcacctgacttttatcaatcacattttcttccataatcttcattgcagatggagcatcctttttctgtataaattgttgcatgtcatcagctactgtaacagtagtactatgtgcagtgttcccctcagatggcttaacagcattcgattttacagtatttattgtacataaaacttgccctctctgtatgatttcctcatcaacaacaaatatttcattaataataccatcttcaggagatacaatttcaagcgaggtcttgtcagtttctatgataaataacatatcaccttgtttcacactatcaccaacattcactgagactctaattggagcctctaatattgactcaccaccaagattttcagcctttacttgtatttcactcataaaatgtaccttaaaaaaactctctacacagacttagttgtacatgccactataccataagcatgactcacaattatgattcaaaccatgacaaaaattcaatatttaaatctcattttatacttaaatagaaatctgacttacaacaataatacattactactaaagtattacaatcatatattctacataatactaatctttactcattgatattactttcaataaaaatttaataatcaacatatattgctatacctttcatttgatttactatcaacatcacatagtacaacaagtacacatttattataacattatcacaactttaacatttaactcaataataaagcgttattgaaattcaataaacaacttttacacaaaaatagtaatcagcataaatcttctcctaacaatttgctgtagtttatcatcttaaatagtcacgagataactgtatataattactagcagattccttaatgtgatttatttcttcttcagaaagcatcctaaaaaattttgctggcctaccagcccacaactctccagacttgattattttacctttagttactaaagagccagatgctagcattgtattctcttccataattactttatccataacaacagaacccataccaacaaatgcataatcatgtatttgacaagcatgtaatatacaactatgcccaactgtcaccattttcccaatttgtgtatcaccataatttctatcaacatgtatcacagtattatcttgaatattagtaccttcacctacactaatcattcctacatctccacgcaacactgagttataccatacacttgcatccttactaatataaacattgcctataacaaaagcagtaggtgcaacaaacacagtactatctatgttaggaaaaaaattcttgtaactgattacattatgcataaaatcactcacttacccacaaacctatatctaatgtttgtatgataacatatcttatacaatgctataaggccagaatttacataacatttacatgcaaccccttaaatctaaacttatacagctatacgactttatataaaaacaacattcctcagcatatcaaatacattgtaacaaaaaatttgcactacacatttgttaaaaaaacataaagtatcttctactgacagttatcacaaaatatattaagcaattatatattgatctaatacaaagattgatatataaaagctcataggttctctgaaatatttttacaatgttacgccatataatccttctactgttatattgttttattagtattcaggtacatataagtaatgctgtggccttacctatacaaacaacagcacctcaagcagcagtattcgatttcttttctaatacaatgttattagaacacaacattgacgaacaaattgcaccctcgtctatgactaacttaatgaccttatatgttacattttactacataaaagctggatttgtaaaaatggaggataaatttaagactagtaaagaggcttggcagaaaggaggtaactccattttcctaagggcgggacagctagtagcagtaagagatttaattaatggtattattacaacatctgcaaatgacgcctgtattactcttgcagaaggcgtagcaggttcacaggagaactttgttgatgaaatgaatcgtatagcacaaaaacttaacctaacaaaatctcatttcagcaatgtaataggtgctcaagataaaaatcaattcatgtcaatacgcgacttaataactcttacagtaagaattttcgaagattttcctgaatattatcatctattctccaaaaaagattttaagtacaataatatataccaagaaaacatcaacttattgtcaccagataatagaatagatgggataattagcatatatacagatgcaggaggatacgggtctatagtagctgctaaacatgaaggcagacgtatcttcatattaatcagcggtcttaaaactgaaaaagaacgcatatctgaaataaagcagttgctagattatgcttttaatgattttagcagccaaaccatctttcacaaaggtagtaaagccaaggaaataatagttaaaaacggtgatgcaaaatatgtagaagctgtgttcaataacgatgtgattattctatatcctaaaggctcatatgatacagtcaaaacctttttttcacacgaaaatgcaatatctgcaccagtaaaaaaaggacaagaagttggtcatcttcacatacaggtaccagaacttacagaacgcgttatacctatgtacgcagcaaatgatataaaccatctcaatttcttccaaagaatattgtacatgttttcccctaaaacagataaagttgctacttcataatgtacagtcatagttctaactcatatcaagtttaaagttatataatatgcataaacaaacgctgtgtttattaatgacttaaatcacatacttttataaaaatttacacatattctttaataaagctattttccttacaaagaacttatatacattgtttaagtagtactttatagaaagcccatagttacataagcttttcatcaagaacttaaaagatcaattataaatcagcaatctctttaacttttacttgttttattaattatgtaaacctaccactatattaaaaacataagatacaatatgaatacatttctacttttctctaatttgtatagtcttgttatgaagtacgctttaatatttatataaaaactagaacaacgtaataaccactataaaaactgcctatagaaattattaaaaatcatatcctaaacttgctatattaattgccacaacgagacaataacattaacagcataaaaaataaagtaacagaactttcatagaactaggaatataataatatttataatatcaacaaataaaaaacttactattttacatatttgtttataatatcaattactatcttttcactgaggacttgtggtaaaactttaatcttaactccatcaacatacaatacataaagcggtacactatttttatccaactgattaatatactctgttaattcataatttttagaagttaaatcacctctcatgtagtaaatttttttcttcataagcaaagcctgtacagtgtccaactgtaaaattttttcattaactttacaagttaaacaccaatctgcacttacagacaacaatactgtctctttcgcttcaagtagttgttctaacttcttttgagaaaattccattactacaacatgttttgcttccttatgtttcattagaaactcttttattggctcaaaacataaaggagaaattgctataaacaataaacacaagcaaattacaaacttacttataggttcccaagattttataaatttcataatccatatccccatgacaaataatatagcacaagataacacagcaaataatatttccggacctttctgtttgattaaaatacagagtaaccacgctgaagaaaaataaagtgggaaagctaaaaatctttgtaaaacttccatccatctacctggcttaggaataattttcaataaacctggaaaaaatgacaataataaataaggcaacgcaattccaaaaccaagaacttgaaaaatcaacactgagtaaaggttagattgatttaaagctacagttacagcagataccataaaaggggctgtacacggggtagcaacaaacgttgataacatacccacaataaaactacctattaatccttctcttttagaattcacattattaaaattaggaacaataaaaggcaaatcataaaatccagaaaaagataatcccatcaaaaacattatatacatcaacaatgcaattaatattggaaattgcatttgatatccccaacttactaaatagccaaaatgacgtaatattaaaagtattgaagacagtagaaacatactcaccataactccaagtgtatataataccccatcagctcttatcaatattttactcttttgagcattcttaaccattgacattatttttaatgataagatagggaatacacatggcatacaatttaaaattatgccgccaagtaaagcacatatcaaaatgtatattgaattaacattaaaaaacatatttaaatattctaaaaaggatataacattaactattaaattaaaaaaatgcacacaagacaactataagtttgtatacctaaaaaactattaacattaataaagacaaatttactattctaaatcacataatttaagaaataaatctacttattgttacaaatcatagctagctttacattctaagttatttatataataaattcaataattaacaaatatgttcaaattaacattaagtgatgtcaaacaatacacacttctaatatacctagacatattataccttatgttcagtctgcaaattttgattttattaatgactcattaatcctgataatatctttcataatgttattatctaagtactgtggaattaattcctctcctgtaatatacttataaagttgataatcactagtattgacaattttctcatattcatcaacgtccttagaagacaatagatgaatgcaatgcaatgcaaaattaccaagtattatatccatttctttgcaccctctatgcaaactcctatataataatctcttacgttttactagtaattcatccataacatttatgttcaacagatttcaaattgtctaattaaaattattacatattatgttgtcaaccatataaatatactatattatccaatttagttttaatgacatctagtgttctacttatggcaagtattattgataacttatatcatgtactcaataatggttcattttatttgctgtcgtttctcattataatgtctattatagttttcgtacatgaatacggtcattatattgttgcaaaattatgcaatgtgaaggttgaagttttttctataggatttggcccagagttatttggaattaacgataagtctggcacaaggtggaagttcagcgtgataccaataggtgggtatgtaaagatgttaggggatgaagacccagcaagtgttgaagcaaatcctaaccgtttgtcagaagaagataagttacttgcattttgtgaaaaacctctataccaaaaatttcttattgtatttgctggaccattcgcaaatttagtgtttgctatagtagtactcatgatgttcttcactactaaaggaatgatgaagcacaactctgtcattggaggcgtagtacaagatagtgcagcacaacatgcaggattagcttcaggggatacaattctaaaaatcaacgactaccaggttaaatggtttgaagaaattaaacagtatatagaaaaatatgcaaaagataatcaagagctaactatagaatatgcacgtgacgggcacattcatgttgtgaaagttaaaccaagcattaaggaagaaaaaggactttttggaagcataaagaaaagtccatttttaggagttacaatgagtaatgtactcagcaattatgaatttcagagattaagcatcactagtgcttttgttcagtccattaattacacttatttactgtcaaagtcaatttttcaagtattgggacaaatgttggtagggaaacgcagtatttctgagttaggtggtcctatacgcattgctcaatattctggagaatcagtaaaacacaacgaagtactattgtgcatggcaatgatttccattaacctaggtgtaatgaatttattaccaattcctatgctagatggtggacatattttccaatattttgtccaagctatattacgacgcaaacaactcaatcctaaatatcagcggtatatatctacaattgggttaatgcttctgctatctttaatgatttttgtcacgtttaacgatataaaaagtatgtttaagtagttttatgagatacattattattattttaatattatttacttcttctcttgcacatgcagaggctttaaatactaaaattaagcaagttcaaatcaatggcaaccataggttagattacaaaactatatatttttactcaaaaattaacttacaagataatgtaacacaagagactatagatcaaatcattaaaaacttacattcaacacaactattttcacatatagaagtatatgttaatcaggataattacttagtaatcaatgtaacagaaaatcctgtcatcaataatatagttttctatggaaacaaagaattcagtaaaaaagatctcgtaaatgatatcttaaaattaaaaaagttagcagtttttacaaaatcaaaattacagcaagatatatcaaatcttttatcactataccaaagcaaaggtaagttaagcgcaaaagttacctatgaagtaaaagaacttgagaataataaaatagatatcattataaaaataaatgaaggaccaacatcaagaataaaaattattaaatttactggaaatcagttcttttcagatgcaatgttaaaaaaagctatacaatcaagtgaatactatccttataaaatattcagtagtaatacaaaatttgcttctgaaagattaatgcttgatcaagcaggattatataacttttacacatctaaaggttttatagactttaagattaaatctgtagtaccagaaattagagaagatcataatattaatcttattttcgctgttgaagaagggataaggtataagtttggtaatagtaacatcatcatagataaacaagttagtaatcaccaacaactaaaagaagaaattcagaatcttatattatcaaaaagtggtgatacatttaaccgagaatccattaataattctatcgaaaaaattacccaatatttaagtaacaatggaaacttcttttcagatataaagcatgaataccgtgtcaaggatgatgtggtcgatatagattacataatatatacaggcaataaagtttacattaataatataagtatcactaacaacaagactactttagatcaagtaatcagacgaaagttgactatttctgaaggcgacatatataatgccagcgtcattaatagatcttataaaaacatattaggattaggtttttttgagtctgtaaatgtagagaatcataaaataaatgacagcttagttgatttaaattttcaagttaaagaaagaggtactggtacattttctgtatcagcaggattttctagtgtcaccggacttgtaggtaaaataaacatacaagagagaaacttatttggaactggaaaaatattgtctttacaagcagaaaaatctacttcttccttatctagcagcattgattttgtagtgccaaatttctcagagactgattcagcagtagggtttggtttattctattcacatcagaacaaaccaaaaggcaaagattttccaaatctcattaacccagccgctattacaggtaatacagatgctgcattcagcagcagcaacgctggtttcatgttacatacatcacatgatataactgatgacctcaatcttgcattgcactatgcttacaaacatgtaaacatatttaatgttaaagatactgcatctgaattaattaaggaacaagctggtaagaatattgattcatccgttggttattctcttcaattccgcaagtttgataatttatctaaaattaaggatggatatcttgttaagctacatcaaagcttttccggattaggtggaacactacattacattaaaaccgaaggttctgtaaattatagcagagagattcttcctaaagttagtagcgatatccttttaaacattaaaacttctatgggatatgtattctcatataaaagtgatgagcaagtaaaaatcaatcaacgtttcataataggaagcaatgaaatcagaggattccatgtatcaggtataggaccaagagataaaaagacattagatgcattaggtggaaagttttactttaatatgattaatcaagttgattttcctatcggtttaccagacgatttgggaataaaaggctctctctttgtcgatgcagcaactttatttggccttgactatataaataaagaatattatgaagacaaatcactaagagtttctgtaggctttggtatttcatggcgttctccatttggaccaatgagattagattttggcttccctatactaaaaaaagactatgatgttacagacatgataagattttcaatgcaatagaaaaaagaggtatttatgcaattaaggttatttttagctatttttatattactattcggtttaagttgccaagcttcggcaaaaaatgatcagaacatccctgtagccttcattgatcgtgatctaattatatctgaagcactcgcagtaaaaagcattagaacacaattagacaacaaaagagaagaactacagaaagatttttcagcaagagaagaagagttgcataaaatcgaagaagatttaagtaagcaaaaagctatcttaagttctgaagcttttgaaaagaaagttgcagattttaaaataaaggtatcaaatctacaacaagatatttctgtaaaaggatcagaattagaaaatatgtatatgaacgctatggagatggtttacaataagattaaaaacatctcagctaaaatagcaaaggaaagaagcattagcttagttttattcttaatgaagaaaaatcaagtattttacgctgctgataatatagatttttctaacgaagtattagaaatgttaaacaaagaattaccaaatatagaaataaagaagtgagatattaattagagatttgtatgcagttcaatattcaagaaatcataaaaatgataccacattcgtatccatttttgttaattgatagagtaactgcatgcacacctaatgaatctgtaacagcaataaaaaatgttacttttaatgaacctttttttattggtcatttccctggtaatccaattatgcctggcgtacttattgtagaagctatggcacaagcatgtataatatgtacaatgagtagcatgcagaattactccgtatatctcatgtcaatagagctagcaaaatttcgcaagcctgttattccaggagacacattaattcttacagtaaacgttgtacataaaagaaaaaatacatgcaagtttgagtgtcatgcacatgtagagggtacattagttgcagaagcacaaattctagcaatgactaaacaaaatgaagcatgatttttttaaatttatacatcaatttttagaaaaatatgaaaataaaaagagcaattatatctgtatataataaaacaaacattatagaacttgcaaaatttttaattgaacaaaaggtagaaattattgcaacaagtagtacttataaagctttattagatgcaggattacaagtaacagaagtatctagttacacaaagttcccagaaataatggatgggagagtaaaaactttacatccaaaaattcatggtggaatattaagtaatcgcaacactcatgctgcagaatgtctaaagctagacatacatgatatagatttagtgattgtgaatttatatcccttctctcaagttgcaaataataaaacttcaaccgaaaatgagataatagaacaaatagatatagggggagttactttattaagagctggagcaaaaaacttccacaatgtaacagtaatatcagatatcaatgactatgatacattaaaggcagaaatgattaataatcaaaattctacaaacttaacatatagaaaacaattagcaaaaaaagcatttgctataacttcatcttatgatagtagcatatataattggttaaataaagatagtaaagatatactacctgaaacgcttgtcatacatggaaataaggtacaggatctcagatgcggggaaaatccacatcaaaaaggtgcgttttacagtactttaggggataaataccctctcaaacaattacatggaaaagaattaagctacaacaatatagtagatatagaatctgctataaacatagtgacagaatttacgcaaccagcagcagtgattataaaacatagtaatccttgtggtgcagcaactgctgatgacattacaactgcatacaacaaagcttttgcttgtgatccaaaaagcagttttggtggtattgttgcattaaatagagaaatcaacgaagatatagcagaggaaatcaataaaattttcatcgaagtaatagttggtccatctattacagacaaagcaatggaaattatacaaaagaagaaaaatgtgcgtattatgctgtccacagagtataatccaccaaaatatataattaaaaatgtcagtaacggatttctactacaagaaagtaatacaaaccaattatcagagaaagacttaatacaagttacaaatttcccagtatcagatgatactatttctaatctattatttgcttggaaaatatgtaaacatgtaaaatccaatgcaattgttattgcaaaagatcaccgtgcaattggagttggggctggtcaaatgagccgtgttgatagtcttgaaattgcaataaaaaaagcccaagattgcgcaggagcagttttagcgtccgacgcattttttccctttacagacagtatattactaagtgcatctgtaaatataagtgcaataattcaacctggaggatcactaagagatcaagaagtcatagaagaagcaaacaataaaaagattgctatgtttttcaccaacattagaaacttttatcactaacagataacttattactactcaacatcaatataacaacctaaaataagcacaatgactataggtgacaatcaagtaaacaaacaaaatgctatacttaacattagaattgtcacatcaactaataatagcttttatattgattcttaggctaacataactatataaacaatatacagttatagcattacaaatttatgataggtaataattaatttgcaagtaacattaatgtaaaactgctattccattaatattagatatccaaacatttaataacttttgaattaatatcaatgcaataactgtataaacagcataccagctatcatgtcataaatttgcagtagacgatatataactattcccactagtagcattaacatttttatcctatattagatagatagtaatgataaagcaagaattccagttattagatgaccaataacgctttcctttctcaaaaatactctaatcaaatgtactattaaaagcaccaataacataaaaaacgcaatacaagcaactattgaataatatttaatattgcatatcacaaagtatctgccacttcgatagagctgaacagaaaaaacaaacaactctctttacggatatatatacttgagagcaatacaaatataaacgtatgcagaatacatagtcaagacagctgctaaatatagtatcgtttcaccaatgtacaatatcacactatcatttaacattaacatagcaatagcagccatttgtataaatgtttttacctttcccaacttaattacaggaagttcaacgcttatagaaatcaaaaattctctcaaaccagaaattaaaatttctctacagattattacaactacagggataatagttaatcccgtaattttacgtatataaactaacataataacggttgcaactacaataagtttatcagcaatcggatcaaacaatttaccaaatttagactgtgcttgccatatacgcgctaaataaccatcaaaaaaatctgtaatacatgcaaaaataaaaataacaaacgcaatataattcgagttactatccccaatataaaagctacatacaatagcaggaattgcaaatactctaaatatagttaacaaattaggcaaagttcttctaaaataatcaaccataatgcataatatcttatattccaccctataataatgataatctcaataacttcaatatttatattaaagttatgtgttattcaaattatgtatatggaaacaactctaacaaacatcacttctacctttaaaatattaattgcatatatacaatttatataaagcaccaattatgaaaactatctactaatttttaatattacatccttagtaaagctatgaaaagattaattaaatgctcttgtgtattttaacagtagatttataatttagcttttaaaaagaccatgcataattatgtcttatataaataactataacatacaactatgtcgtaagtggttattattagctgtatctgctttagcaatatctggacttttatccatatttgtaattttgctcagattgcctatatcaaaatcttttatcacagatgtagataaagtgtttgatatatcgctagtaatacatgttaacttatcagtactagtatgggcatcctcaatcatttctataatatcaagcttaataatttccactaacaagtattcaaaatgtttcaaatatctatgctactccgcatttattggtacatttttaatggtgctatctattttttttcctaatgcagaaccaataaaaaataattacgttcctgtaataaataacttatgttttttactaggactatttatatttactgcaagcatacttttttactcaatattatcaactaaatgtcatcacctaaatattcttcaaggcatttcattgggaatacacggcattccaataatactcatatgcgctgttctatgtttcactatggcttattacacaatacacacaaacaactatttccacataacatctttttatgaaaatatattttggggaggaggacatatactgcaactagctttttgtcaggcattactaatagtatacttaattatattaggaaaaaacactaaactacttaataaaaacgtaatccacgtcatatttataataaacacattatcagttatcgtagcacctatcatatacatatatcatccagccgattctcaatttaccatagatttcttcacatggcatatgcgtattcttggaggagtaatacccgtattcttattcatacttacactattcaatctcaaaatattgctaaaacatagctatcatagtctattatgtacaactttactatttagctatggtggtatactaggaatattaagtattcatggtaatgtaacaatacctgcacattatcatggatctattgttggaatgactatcgcattcatgggattcatttactggctcctaccaaaattaaaccttggcaatacaaatagcttttatactaatcttcaaatttacatatacagtttaggacaatttctacatataaccggattagaatggttaggtggatatggagcattaagaaaagtaacatatttacctgatacagcatcaaaaattgcaaaacactgttttacaatcggtggacttatggcaattattggtggatgtttatttgtaataatagtactactacaaatccgaaaaaaagaagcttaacttaaaactagcgaataaaaactttattgccgtataaaaaattaccactacaactatacattcacatatcaaaaattttattaagacacaacagcaattttctagaaatacaacacttctactaacccaataattgatacttttattagtttaattattttacacagccttaaaaaaattaccattataactgtacattcacacatcaaaaattttatacaagacccaacagcaattttctagaaatacaacacttctattaacccaaataattgatacttttatcaggttaattattttatatagcatttaaaaaattaccattataattgtacattcacacatcaaaaattttatacaagacccaacagcaattttctagaaatacaacacttctattaacccaaataattgatacttttatcaggttaattattttatatagccttaaaaaaactaccattataattgacattcacacatcaaaaattttatacaaaactcaacagcaattttccagaaatataacacctctattaacccaaataattgatacttttatcaggttaattattttatatagcatttaaaaaatcaccattataattgtacattcacacatcaaaaactttatataagacacgacagtaattttctagaaatacaacacttctattaatccaaataattgatacttttatcagtttaattatcttatatagccctatacctataaaaaaccacatgtaaacaactcattgaaaaatacttatttagaatcacagtagcattacaaatttacaaaaagaaacttataaataccaatagtaaaaatattacctatagtaacccattaaacatacatcagagcatagtaacaaaccttgagttcaacattggaacattaagttaagagctacagcgtttttactactataaaatcaacactactactacataaattaccttttacaattaaacatacaacaaactataggaatgcagtatattttgctgacatctataacaaaatcgtattatctttatgctacattaagtttaacattttacttataacgacataagtatataccttactaaccataccaacactgataagtacaaagtaataacatattcaaaattaccttttataattaaatatacaacaaactataggaatacagtatattttgctgataaatccataacagaactgtattatcttttgctacattaagtttaacatcttatttataacgacataagtatatataccctactaaccatatcaacgctgataagtaccaagtaatcacatattcaagatgatcatttctaactttcaatggaacattagctgttataccatcaaacactactgcattaccagcccatattatacaactctctaaaggtatattaatgtgtttcatcatattttctatatcaaaccagaaccacacgttagcattaacgtcattttttacaaaccatccaacctttttgttactatcacaatataaaattccttgaatattctgttgagtagtattgttaatttcaagcttacttgtcttatctaacactgtacccttgttgactaatatatatctaccatcatttaaatgaaaaggttgcaatacataataacctaatgttcctgcaaaaacaaaaaatctataatcattatcaaatgtaccatttacttctatatttttataattttgttttactaaatcatgaactgataatttagtagatggtacctgcatagcatggataatattggttttttcttttagtctaaatatttgccatgtaccaagagaaatcattatagaaaaggggatgacaaaaacaataattagttttaaccacatatcatttattctgtaaatacgctaacatattagactataacgttcatactataacaaaaatacaaattttcattctatgaaattatcagaaaaattttattctactacattgaatgacaaacattatattacaaattacaacagtgctaaaaacaatcaaactatactttctcacaaatctgcacggtagaaaaattatagaaactcataccattaaacttttcctatatttcgttacatcgaataacaaatattataaatatatagtaatatgccaaaaatagcatacaaacattacatcagtttatataacctccttttatatgttcatactatacaagaaaaaaaataatctactttaatatctaaaaaaatatacaatagcaaaactaacattaacaattttatgagatttattacttataataagctaaactacattgtcaacctatacaagtatactatgaagcattgtataaaacacacttttacagttttaataatatatacattacttttgaacactaatatatgttttgcccatacgacagatcaagataatttttttactgtaaaacgcacttcttatactaaagaagattttgtaagcttcatagtaaaatgtcatgctaaaggaatacctttagatttcaagaaggaattcggcaataatttatctggagcagattttagtgatctagaccttcgaggatcagtatttgataacgttaacctactacatgcaaattttactagagctaacttatccaattccacttttatagattccaatatgcaaggagcatccttcattaatgcaaacttaagtaaatccaacataaaaaattcaaacttaaattttgccaatttcacatctgcagatttacaaaaaactacaattacacaatcaaaaatcaacaatacaaactttagttactcagacatgcgcttttctattctaacagaagtcaatggatcccttgcaaacttttctgaaacagaattaaaactagtttcaatattcaactctaatatagaaaaagcaaattttcatgacattgaaggtgaaaatatagtaatccaaaattgtaatttactagattcaaacttttttggagcaaatttaaataattcaaaaattcaattttcaaatctcacaaatactatcctatacgcagtaaatctagattcatcagatataacaggaagtaacctaagtaatagcaacatggaagtatcaaatatttcttttgctaattttcacaatgctaatttaagcaatacaaacatgcatcttgtagatgctcattatacaaatcttaataatacaaatttacataaagttcgtatgagtgatgcaactctaattggagtaaatttaaatcatgctgtgttatctaacgcagatttgagcaacgcagatttaagcaatgtcagcatagaagaatcagatatgcaagaaatacttcttgactctactaatattacaagaacgaatatgaagcatgctattttaaataacgcaactattaataatacagttatttcaaattctgaccttacgatgacattaataaaagattctaaatggaataactctagtatctattcaagcaaattaacctctgcagttatagataacaacattattaaacatggtacatatgataaagtaaatgcaacaaatacattatggtctaattcaacaatagaagatagcaacataattttctgcaattttgaatctgcaatattcaataatgataaaatacataaagtgagcttttttacaaatcacttagaatccgcaaaagtagaagattcaaacatagtcggatctagcatttacaaaaatactctcaccaatttcataattaataattgtgacattaaaaatacaatcattatcaacaataagaattttgtaccaacagaattttctaaacaggcaattacatctattacagctttacaagacgctatcacaaacaataaagtatttgatgtcaatttttctaattttgattttagaaaaataaacttaaacaatgcaaatttttcaaactctatattaaagaatgcaaacttttcaggatcacaattagaaaacgtaaattttactaacacaaatctacaatcttctcaatttgaaaactcacaacttaaaaatgtagatttttctaatgcaaatttagaaaacgcgaacttatcgaacagtaaattaaatgatatcaacacatacaaaacaaatttgcgtcacgtaaaaactgacaatactcagaaataaataaagatttaaacttatacactaaaacaacatcaaataattttatagattgtaataacatatgattcagttacatatcttcaactatcgcaaatctaccatgatgcgcaatatcaagaaacgtaaatcttgatctagtaataaacgcaaattctattgctttactatattgactaatattccatccaatatgctctggtttattgggacaacctatgttaaccagcatgtcttttaataatatatcagataatgttttctctgtaattttttcaacaataaaagaccacttatccttaatcaagctattcaaataatccgccttttgttgattaataaacttttgagcaagtatatcacaatactcttgagtatactgcatatgaaaacactgttttatatcttcatcatttatcaatgtaggataaaaccttggtactgatttcaaaatcctatgttgtaaacatgtcatagttgacatacttacacctattaattcaccatgaaagaaatgcatatcatcttgtaaaagttctatggtactagcaatcatatgttcaccctgactagcagattgacttccgcctacaataaacatacccaatcctgataagagcaaagcttgcattaaaagcataatactatactcatcatgttttattaaccctagataatcgttgattaatgcattttcacttcttttgctaattaaaaacggcaattcagtatattcactacctaacaacaaatgtgataataaccaatctgcctgtactgtagatctacaaataaaatcagcaaaaccacttattattaatctttggggagcatttacaataatatcaacatctatatatatagcttcaggtaaatgagcttgtaatgattttttatgtccattgtttaatactatagatgcattagatgaaacatatccattcatagaaggagctgttggaaatgagatatagcgcttatttgtaatgtaacttacatatttacaaatatcattgattgtaccactaccaaaagatactaaaacatctgaatcccgagatttctctttaattagttccactaatttttgagaagcacaagaccaacgaggaataataaaatgtgcaacactattaaatacaaccttgttcaacagaggagcaagattaacatctgtaactatgaaaccactattaccatactgtttaattatatcgcatatattgtcactgattctcttactaatacgtatactctttattgcattaactactgactccaacttacaaaaactttcatcaactagaatctgctttaaaaatttatcatacataataaagaaacaaccaatgtgttaattattatatatctaataagctcataatacaaaaaaacattctatttattaaaacagtacatcataacttatattgctttcatacaaccaatctacataaacaagcgatcatttcttatataacaggaattggtatatattgttataatcttaatatataatcttcaacaacgacaggttataatactagctacaaaactatctaattcctacaaaatattaagttgttaccacaacaacatataattttaaaacaaggaataacttataatagctaactacaacatctataatttcttttatatcataaaatactatacacacctatcctaaaacttaaaaaagaaatcatataattttttatagtcacataactccaattgactaactgtctgcaattgatatgattaagtataatattctttaataatatcgtgtttgtatggagcataaatgtcagcaaaccccttagatcagtttaaaatttcgactatatttaagttgcctagtattggtgggtacaatatagatttcaccaatgcatcactgtttatggtgttatctacacttataatctcccttttctgctatattggattaaggaaagaaaatatccttccaaatagtatgcaactaatcattgaagcaatctacaattttatcgtttcaacaatagaaagtaatgtaggaagaaaaggattacaatatatccccttggttttcacaatattcacattcattgcaacatgtaacctattaggtgtcctaccactaggatttaccgttactagtcacattgccgtaacattcgcaatatccatggttgtatttatcagcgttacagcaatagggtttaagcatcagggaatacattttctacgtatactattaccaaaaggtaccccaggttggctagctccaatgatggtatttattgagttgtttgcatattgtgcacgtcctgtaagcttatcaatacgtcttgctgctaatatgatagcaggacataccataatcaaagtaatagcaggattcgtaataaaaatgaacatatttctcacccctttgcctatggctttcattatcattttaattgggtttgaaatatttgttgcaatattacaagcatacatatttacagtgctaacttgcgtatacttatcagatgcgatcaacgagcactaaattttatcaattgacttcacatgttgatgtacttataatacgtttaactttttataaaggtaggagtatatggaatctttgaagtttattgctgtagggttaagtgtttttggtatggttgcttctgctctaggagtagcaaatatattttctaccatgcttaacggtttagcacgtaatcctgaaacagaagataaattaaaaaaatacgtttataccggtgctgctctagttgaagctatgggtctattctcttttcttttagcgctattattaatttttgtagcttagcatagatcatggatacaataccacaattagacataacatcttatccttctcagttattttggttctttctatcttttggtattttatattttttgatcagcaagaatattataccaaaacttgaaaatgttttaaaaaaaaggtatactgttacgatagactctgtagattgtgttgaaaacaatttaattctcgcacaagatgagttaaaaaagcagttatctaacctagaagaagcaaaagctgaagcagataggattatcagttctgctcttcaagaagtaaaacgcactaatgcagatttaatagttttattaaatgaagaaatacaagggatgtttagtatagcagatgaatatatgcataacttaaagcgccaaacagaacaagagttaatagatcttacgtgcgaaatagcttcaatgtactacaataaaatgctaggtactgctgaatatgttgataaagataagttacgcgatataactactagattatacaaggagaaaatatgatatccacatattttattaccaacattgcattttgcatcggagccttgtcagctttttggccattatataggaaaatcaatcagcttttatcttcaatgtcaaacaaggtgagaagggaggttatgttaccttatgatatccaaaaacaatctaaagatttattggatagtgcattaattcaaaattatgaaattgaaaaaaccatagccgaagttctaaagacagcaaatgaagaatacaaacttattattgcatccaacaaaaaagatattgagaatattatagaaaaacatcttgatgcagctgtacaaagaatatctgatcaagcatcagcaatggttcaatcactaaagctaaataccgtcgatattgcagccagtgccgttcaagagttaatcaaagaatacaatgagcatcaaaaacaggataatggtggtgttatttctacaatagatcgcgaccttagaaaaaaattacactgaattttcaacttttactgacacgagttttaaaattttttgtagtatgctaccttttttagtcatggtcttctttttaccatatactctattgacaaccaataaaactgtacctatagctgcagaaaaagatgggttgtatttataatcatcagtaataccttttaattctacaggcaaacctattcttacttgccttttaaagacgttgcttgcgacttctttaacattagttaactgactagaaccacctgtaattattatcttattaatcaagtgtttttgcttaactaccctactttttactatatcaaagatttcttctactcttagtctaattattttccccaaatcagaacgtacaactgaaataacctcatcttcaccaacatcagcttctattataccatttttatctggagacactaacatagcatcaccgtataatacctttatacgttcagcatctttaacactaatacataatccatatgcaatatcattagtaatatgaataccacctaaaggtatactatctgtatacattaattttcccttactaaaaataccaatagacgtatatctaccccctatatccacaaccatagatccaagttctttctcatcatcagcaagacacgacaatcctgaagtataaggctctgctacacatccaactacatttaaatcactacaattagtaatacagttttctatattcaacaatgcagactttgaagcagtcaccacatgcatactagcttttaacttacttccatataatccttttaactctgtaatattattcaaatcatcaaggcggtatactactggtatattatgaagtacaacttgttcatctcgacacttatcataagtttgcagcataatatttctgatatcaacatctgaaacttcatgcatcattgcatcaatttcattaacaacactcatagaactaatatcacacccagatacattaacaaaaacctggcttattactggttcctgtgccatttctttcgctgattctatacaagataatattgaacactttgcagattctatatcaataatagctccaccactgatcccttctgcagctttatatcctatcccaacaatctcaaaatcattgttatgagaaattctaactataaaacaaactatttttgtagagccaagatctacaacagcaaaggtaccacttcctggatctgtaatagtagcagaatataacatacaacatatacgataaatgattaaaaatttatagtattactaactctaagtactcaatgttatatccttacaaaagaatatcaagtttttttcaaatttaaatacacaagtaaacctaggtttaatattttcaacaaacataccttctatgtgcaaattgactaaacattttaatcaacataatactttactaatacaaaaactagcaaatatattacacaccttacaatagagctatgctaactccccccttataagccattcaccataaatatacacaaataaaatgttactaaatacttttataacaccaaaaaagattagaatatctttacttaaggtaacaataataataacttacactgttaggttcaccatcaaacaggccattcactattagatacgcacaggcaaaaaattgtataattccaactttctcatcaacatcaaacaagacaaaaataattttactaaaggtaacatataataataactaacacttagactcactatcaaacaggccattcactattagatacgcacaggcaaaaaattgtataattccaactttctcatcaacatcaaacaagacaaaaacacttttactaaaggtaacatatataatactaacacttagacttactatcaaacaggccattcactattagatatgcacaggcaaaaaattgtataattccaactttctcatcaacatcaaacaagacaaaaacacttttactaaaggcaacatataataatactaacacttagacttactattaaacaggccattcactattagatatgcacagacaaaaaattgtataattccaactttctcatcaacatcaaacaagacaaaaacacttttactaaaggtaacatatataatactaacacttagacttactatcaaacaggccattcactattagatatgcacaggcaaaaaatggtataatttccaaccttcccattaacatcaaacaagacaaaaacactttcactaaaggcaacatatgataataattagcacttggacctactatatctcccatcccaggtcctgtattactaaaagcagcagctactgtactaaaagcagtaataaagttaactccactactagatataagtatgcatcctataaacaatacaaaaacatataaaaaaaagaatagccctatgtctcctataaaatttttactaacatatctcctattatatctaatagtacttgtcctagaatgatgcagaagatcactaatataagcattgaaagctttcaataacaacataattcgataaaccttaataccactattagtagaaccactacacccacctattagcattataaaaacaccaaaaacagaaaaaaaatgccaattactatagtcataattgataaaacccgtagaagtacttaaggaaacaactgaaaatgcagaatatcttaacacgttaggcaaagaataacctgccgttatttcatcaaaatagcaatttattgcagatattattataaaaagaaaaagaattatgccaaaaaatattacttgttcatcataaaagcattgctttgtaataacctttacatagagtatcaatggacaagaacttaataacataaatattattgctatcacctcaatatacacattgttaaaatgttgtagagaatcatcataattagaaaaaccaccagtagatacagttgacatcgcatgacatatagcatcaaaccatgacatcccagcaatccaatatagcattgaacacaaaatgattaataaacaatatatagcaaaaatatacattgatgatctaacaatgccatatttaaattttctagattgatcagaagattcagagcgatataactcatgcaaactcacaactttcaagcaaggcaatagaaaaataccacttacaataatacctaatcctcctattgcatttagcaaagacctccaaattaaaatacctggagactgattttgcaaattagttaatattgttgcaccagtagtagttaaaccagatacagattcaaaaaaagcatctatataagcaatcttatcttcaaaaacaaatggtactgctgctattacagaaagcacaatccatacaacagttgttacaataaaaacttctgtcttttttaaattagataatcttccaatagaaatacatatcaaactaaaaaacaaagtaaaaagacatgcacaaaaaaagttttgccagatatatccagtacaataatccactgctactggaataaacataagtagagaaaaaattaaacaaaacactcctataataaaaattatactacgtaagctcttatacatgacatacattttttgatgaatgtacacttgtaatatagaaccattaacacataattaatgacatttggtatcaataatttgtgcagaagaatctaatcttaaatgcatataatattcgaacactataatcctgcccaaacacatttttgtgtacaaggttactaacaaagtaacttatgacattcggtatcaataatttgtacggaagaatctaatcttaaatgcatatagtattcgaacactataatcctgcccaaacacatctttgtgtacaaggttactaacaaagtaacttatgacatttggtatcaataatttgtacggaagaatctaaccttaacatgcaataatattatctaacactatatgcccaaacacatctttgtgtacaaggctattaacaatgtaatttatgacatttggaaccaataatttgtacggaagaatctaatcttaaatgcatatagtattcgaacactatacctgcccaaacacatctttgtgtacaaggccattaataatgtaattaatgacatttgaacacagaaatctgcaatgagaaatcttaaacttaagcacttgatccaattatatctaaatatgtacacacctctttcagcactatatatcaaacgtaattaataacatttacacctaaacagttttcaatacaataaacctatatactatattgcactactaacaacaataacatcggtaatcttttcactatatcaacaagctcaaattcatatgcattatattctcagtcaaccacaagcaatctatcaaaaatctaacatagaatattgtttttaaaaattctaactaacagtgttaatattaagaaatactgctaatacaaaatgagcattacaattctctaatacatactctacatacatgatatacaataaacagatacttctcaaacaaatacagattctccactaaatccatcatacatttcaaaattaataacatttttactactagactgtacaaaaactcataactataataatgtgaccttggaaaggtggctgagtggtctaaagcgcacgcctggaaagtgtgtatgcagtaatcctgtatcgagggttcgaatccctctctttccgccatgtgtttttattattggggattaatgataaatttagggctgttatttcaaaaaaaaattcaaaacttgaatgataattttgcaattgcagtttctggtggaatagatagcatgacactattacatttatcagcacgatactgtaataagaacacccctatagtattaacagtaaaccatggcttgagacctgaagcagcacaagaagcattgtttgtatttcaacattcacagaatttaaacttaaaatgccacatactaaattggcatggtaaattaccagaaagtaatatacaatcttctgctagacgaatacgatacaagttattactacaatggtgtaatgaaaatagaataaaatatttaatggtagcacatcagaaaaatgatcaagcagagactattatgattaggttagaaagaggaagtgggttagacggattagctggaatgcaagaatacacatacttaaatggtatatgtatacttaggccactcctaagtgctagcaggacagaattattacaatatgcaaacaaaaacaatattacttggataaatgatactagtaataacaataaaaagtacaaaagaaccctataccgcaatatgttagaaataacagataatcctgaagtattaattaatagactttacacagcatcagaacatataaaaagatctctaaattgcatcttacattatgtaaggttagctactgaccaatgtttagagtttaccaacctaggacatattaatataaaactagatatatttttaacactaccagaagaaatatcaataaggcttttaacatactctatcatgtctattggtcaacaaaaatataagccaaggtatagcaaacttagtaatatattttctaaaataaaaaataataaacacaagatagctcaaactttatgtggttgtaaaatcacaacaaatcataataacattatctccattactagagaggtatcagcaatacaagaactcactattaactctgctacaaatatagtaatagaatgggacaatagattcaaaataagtattgtcaattctaatgctgacaatgttactgtttctagtttaaataataattatattccagaagagctaaaaaagttacacagagaagcagtacgttgtttacctatactaaaacataaaaataaaattgttgcttaccccctacaaaataatagtaataataactatattgatcaagtaaagtcatctattataataaaagaggtgttggtcaaacaaaattttatcaatttaacttacagtgaatttatcagcaaggagcctctgctatgagaaaaataattgaagggttagcaatttggattatagtagttgttctggttgctgcagcatatgttcaatttaatgataaaatcattaacggtaataccatcaaattgccattctcagagtttttaaacaagattgataataatgaagtcgaaagcattaatataggcgaacataatattactggaaaattgaaagatggttctaaatttcaaacaactgccatagtatacgacagtttaataaaaacattacataatcagcaagtgacttttacttttttacctgaagatacattctttggggtattaagtaacatattggtatcctggttccctatgttattacttgttataatatggtttatattcctcaaacgtatgcaaataggaggtaaccgcactataaactttagcaaatcacgagcgaaattaatgaccgaaaatcgtaataaagtaacttttaacgatgtagcaggtattgatgaagctaaagaagaattaatcgaaatagtagatttcttgaaacacagacaaaggtttcaaaaattaggaggtaaaataccaaaaggatgcttattaataggttcaccaggtacaggaaaaactttattagcacgagcaattgcaggtgaagcaaatgttccgttttttagtatatctgggtcagattttgtagaaatgtttgtaggtgtgggtgcaagccgtgtgcgcgacatgtttgaacaagggaaaaaaaatgccccatgtatcatattcattgatgagatagatgctgtaggaagacacagaggaattggcttaggtggaggaaatgatgaacgcgaacaaacattaaaccaattacttgttgaaatggatggatttgaatctaatgagggagtaatcatcatcgctgcaactaaccgtccagatgtattagattcagcacttcttagaccaggaagatttgatagacaagttactattagcatacctgatattaacgggcgagaaaaaataattaatgtacatatcaaaaaagtacctacagcaccagatgtcaatattagaaccattgcacgtggtactccaggattctctggagcagatttggcaaatctagtaaatgaagcagcactaatagcagcaagactcaacaaaaaaattgtcacaatgagtgattttgagtatgcaagagacaaagttatgatgggagctgaaagaaaatcactaatgatgacagaagaagaaagaaggctaacagcttatcatgaagcaggacatgctattatcgcatttttcacagaagcatccgatcctatacataaggcaacaatcattccaagaggaagaagtttagggttggtaatgagactaccagaatcagatcgtgtctctcatacaagggaaaaaatgattgcagatttgacagtagcaatgggtggaagagctgctgaggaattgattttcggataccacaaagtaacaagtggagcatcatcagacataaaacaagcaacagaccttgcaaaagccatggttatgaagtggggaatgagcgacaaagtaggtccgttatatcacaatgacgataaaaatgacactatttctaataacttagcaaatttgatagatgaagaggtcaagcttatagtaacatctgcacttgaaagagcaaaaagcctattaaatgagcatttagaatcattacatatagttgctaaaaatttattggaatttgagactctaactggagaagatatcaaaaatataataaatggtaaagaactgaccaaagatgatattgaggaatctcaggttttaaaaagatcattcgcttcaaaacagtaatctaccccttattgtaagacatctgtttatcattggataaagcttaaagccaccgtgttgctgataggttagcatctactaaaataccaaaagtctcaactggaaaagatataaataccacttatcaaatactgataaatctttttcagacttcaaaaactacctaaaaagaacaagcaatttatcctatatgccaaagctatataatacatattattattataaaacgctaacaaataaatttataggtacactacatcaaatttatacatcatcaaaatacaaatttgcataccaaaactcatatgatttaaaaaactatcagataaataaactttaaaatacacaaattttaacacatcatcgctgtatatatactacttacaactttttttatttaagcctaacataacaaaaaactttcaactacatttcaaaaacaccctatacttacaatatcacagaactttaaattgatgtctcttgtaaaaaacttcaaacatacaccaacataaatctagaacacaattccaataactctttcagtccatcaaattagttatgattaggatttaatgtacacaaagatctgaatattacaatcacacttcaaacttacaagaatataccaaaaccttaattctgattggtttaatagcaaaactcataacaaattgttactgcctacaatattaaagtttatatatctattacaacatgtttactctgtctctagcaactcagttttttttacctctatagttacatctacaacataagtagaaggataaagaggactactattttcctttatactcaaatacaaactttgcaaaaatgaagatttttggctatcggaaagaaatggagtaaataattttgttttcattatacagttaaaaatttatattaattctagtatatttacagactatattacctttttcataaaaaggcaacatcgtcttataggcgaatttaaaactgcagtaggacaaacaaattaacatttcacaaagcattaaattatttattacatacaggagttttggatattacagttataatcaacaaaaattcaatcctttcctaaattttcaggatagatgcaataattttacattgacaatttagctttcatcttagctaattttataaaataaaaacccataatcaccatgaaaacagatagcaattgtcccatagttaactgattaaacaaaatgtaaccaacctgagcatcaggttctctaataaactcaataaaaaaccgcactactccataccatatacaataaacagcactcagcattccttgagatgctctaacatttgtaaagaaaaaaagagaattcattattacaaataatagaaacccttcaaaaaaagcttcatataattggctgggatgtctatagaaagaatcaccactattaggaaaaaccataccaaattttatatctgtgaccttaccatataactcaccattaataaaatttgcaatgcgtccaaaaaatattccaacaggtacagcacatgcacctaaatcaagagcagaaagaatacttattttattttttctacaaaaaatatacatgccactaattatccctattaaaccaccatgaaatgacataccaccattccacaacttaaacatttcaataggaaaatgtatataaaaatctaagttataaaacaatatatatcctatcctaccaccaagaattatagaaataacccaccatgacattattgattcataactttctttgctaaaaactctatacttatctatttttcttatataccaataagcaaacactatacccaatacataggataacgaataccactttatttctagtaatcccaatctaaaagctactggatctataatcataaaagtatataaaatatatgttctgaatagtatgaaacaattgcaacattttcgcaactcttaccacatcatatacatacaaacacagaatcctactaactttctctacttaacattagatactatataacacattgcactcaaaacattttgataatatataaatacaatagtgcattatactttatatagcatgactattatgatagtaatatctttagtagaatatttatcttataagttacacaaatttatacggttttttcataagtaatatgctatgtagtaatgataagataaatttatttagtatacttaaacaatgttataagtatacaggtttaactcacgttgtgcttgttataaaatatacttcatgttcttatatatgccgtataagaacttgcatattaaccatgcacatttcactacacctgttaaaaaaacttataatacaagctattctactaagattattatatatttcacacattatgatgtaattttaatacaatctataaaaatattcaacaataacttgctacattatttatttattaataaatgttgagcataatattaatattcaactctaaagagaaaaagtcgtgatatcaaatattattattagtgataacagtagtataacaatatttttcacgggaaaagatgaaatagaaaaattcactaaaatattcactgtattagataaaaacaaagctgctaaagccctgttcaatcatgaagttaatatagaatatcaagataaccgtgcaatattgacatcttctacaaactttgaattcagtgatcttaacaagataataacacacatgttacaacatgattttataattaacacaaataccatagagcaatctctagaacaaggatgtaataccttaaaaactgataacttagttatttgtaggtttaatgataagccactatacagtattaatatcagtattaggaacaacacaattatattacatcctatatccacaaaatatttagacctatcttcagagtacaatcaaaaactaatgagcttactcaaaacacatactagcactagcgatattaccatagataataaacaaaatagtattttactatcgatcaacactgcaatatatgacataatacagtcacttgtaagcacattaataaaagcacaaattaccgaagaaagtgataaagaaaaaattttacaacagttgactaaacttgcttttcatgattttacatctaatgagttacaaattgtaaaaacatagctctatatcctactgatcatcccttaagcaaatataaaaacatagccaaaaatgtagaaaatattttttcacatttagcaagtaaccaactgctagattcatactctgttaaactattacaagatgctataaataatacaggagaattctccacagccccacatattattatgcgtagctttagcaaattgaataaaaacttttatgatcaagtacaaagcataataaatcaggcacaataatttaagattactacacacatattgccttacagcttgaataaacaaatttggagtaaaggaccaaattttaaacgctatctccgactataacaaagaactcccctgctacaaaatcaaacaatatgacaaaccttaatagttacagttaataaaaatccaaactttgaaggctattgcttgataaagaactcatcgaaaaatcaagaataatatacataaatcttgataactatcatttcacaaaaataactctttgtgtaaatactatgttttacctcgctcaacacctacaccttcaacaacactgtcatcaacttgtacacttgttctagtactaacattttctaaatcacgtgcttctatatcaacactaggtgatccttcattttcttgcctacaatcattttgaggttcatgttgtggcaatacaccaaataaccccgctttatatgcattaaaaagtgcaaacttaaatttatcaagaaactgataactatttccttcaacattaacatgtttaacatcatcaagcgcagaaatttgcttcttcatagacacacaagccgtagtactaaggccacctaactttgctactaactctctatcttgcttatagtattgattacataataaagtaacacataacacaacagctgtcatcataaccatcacgctagatactatagggacatacccatccataatacatcctgtatacaagaaaaatgcacttatcgttaacataaacactgcaaacatcatacaaacagcagcacaaatttttgaggttgtagtttttaaagaaagtaagtatattccttctgcaaatatcacaagatatgatagcatcgaacaatacaaagccgctttatcacatttcagaagatgacatgccaatgctaccatgtgtgcaagacatacaaacgctaataccaaaaacgttgtaattcttgtccataattgtctttttgtaagttcttcattactagctacaaggagtagattatgtttttcacttactgcttttcccaaatcagtaggttgatcaccctctccttcatgttctttaacaaatcccctttttttcgcttcttctatgatgtatgattgcactgctttttctcttgctttatcagttccattaaccataacatcataaacaccctctgatgcatttgcatataaccgacattgccatggcaataaattcatattatatgcttgttctctaagctccaaattcccaatataagataataaaagaagtggaggaagcaaaggaagagcaagagacaatacactcgcaacacatcttatcactttctcttgagttgtaagtaaagaccatcgttcagcatacaacactgcatcatatagtttctgttttaatggtttactgtttggatcatatgtagctatatgaatttcgcgtggaggtttaccaccagcactactgtcagcaaaattctttttgtttctttttacaatactacatatatcacgtgatgtatacccatcacgagaagaaacaatcaatacagtcctatgactatactgtttggttagactataaacaggagtgtcttcactgtctaatattggataatcagcacatactactggtacaaatcctaatcctctgacaaaatccgcaagttcttgtacatcaccttctttcttagaacgatgcacaaatactctgcttaaaaagtttccatctatatcatcaccctgaggtccaaccataacagatgctggtgtaacattacgcactaattgtcctacacgaacaataccaacacctggaatatgaaaaacaacacgttttagctctttaaaaagtttatcatacgcatggtaatcttgactattttgcataagtattgaaaaaaaactatctactataaggatacgatataattcctgcaaatacattaattatttaagcatagaagtaaggattttatttctggtaaagatcattacgtttttgtcaagcacattgaatacttactgtcagttttatacaaaaccaactaaccacttgtttgcacgatgacaaactagatattctaaaagctcaacaataaatactgcatatactcttcattacagttttaattaacattttttttaattacaactctaaatttgtgatattacaaatgtaggatgttcttatagtgttatgtttttgaaatgcagttgaaagttttttagttatgttaaacttaaataaaaagttgtaagtagtatatacagtaatggtacttaaagtattacaaacacactcacatcaatctcgagaggcaaaagcaaaaaccttactacagtagggacaactaacttcttgtccaattttaacagtcaaatatattttcggatgttcaatatactcagaagcattcccttccccactgcaacaaactattttcactttatctttctcatcactaccagacataaatcaacttttcaaaatttcacaaatcatatacttaatgtcttcaaattaaataatctaatatataaatctattagcatctttgttaaagttattgcagaaaacatggaacataaaatacctattgataatgtaatagcaaatccactaatagggccactacctattacaaacataattgcagcaacaattaatgtggtaacattagaatcaaatatcgttgacatagcatttttaaagccagattctacagcccattttaacttttttgtagactttaactcttctttaatacgctcaaaaatcaacacattagcatccacagacattccaactgtcaaagtaattcctgcaagtccaggtaatgtaagcgtagcttgaagcaatgtaagtatggtaataataaaaacaatattaaaaactaatccaattacagctaaaacaccaaatatacgataagaaaatataataaaaatagaaactgctacaattgatattatcattgctaatctaccttgcttaatgtattcagcacctagactagaacctattgttttttcttctattactttcaaaggtactggcaaagctccagattttaacaatatagataattcttttgcagtttcaaccgtaaaattaccactaatttcaccacttccagttaaaataggttcacgtattataggagcagtaagtactactccatccagcactatagcaaatggtttattaaagttttcttttgtaattttagcaaactttttagctgctgcattattcagcttaaaatgtacaactacgttaccaagattatttataccagatgacacatctattaaagaatcaccactaatttcaactttttttaatataggatatgtatttccacgatgatccttaagcaaaacagtagtaagaggattaatagatgataactgactaacattttctagcaagtgaaatgtcagctttgctgtcttgcccaataacgtcttgatttgactagtatcatgtaccccaggaatttgcagagagattctatctttaccatgactatttataataatctcttttgtaccagatttatctaacctacgtcttatgttactaatagaatcagatataacattcctcaacaaacttgccttataactgtcataaaaagacatgacaatctgaccttcctgttcaaatactctaacgtttttattatcaaacaactttattttattaaaatcctgactactttttagtaccaacaccagtttatcctgctctacatctagtttactatactctatttttttgctggataaaaattcactcatttcatcatacaagctatacattctttcttttaaatattctttaaaatccgcttctaacaacaagtaaacaccaccttgcagatctaatcctagattaactttttgttttgacagcaaaaatttactattaataaaatttggtagtattaaatatatagcaagaacacataacaaggtcacaactataggcttaatttgtaacttagaaaacatatcatctaccaaatatatctggctattatattatattattgcaacaaacaaaatattttatatttctaagacaaatcactaatctaatacagcacaacataatatgaatgcaaccaaattgaaaaacatcgtacttaaacaaatgtataatgttttcatgtatacttaacactccttattcaaaaacttattaatctatcaaacacattgcattttaatcataacaataggataaaaccctctatattaaaaataatacatattaaatgctatttaactcttacatcctatttcatttatagatatacacatcaaataagtaattaatctaaaaacacaatttgctctcataataattataatcataaggatcgactttcatattgtcactacatgctatacatgcactatttttttgaaatgtatatttagtaaactcattagatcgcaagtctattctctgcaaattccctactaaattatctggaatttttaataaatattttatagtttctgcaactgcaatacttcctactactcccaccgttgctccaagtattccagcattagaacaatttaagtgcagactcatatattgacattcaaaaaaacatcttagacaaggtttaccataaggaaatactgttaacacttgtccagtaaatccaatcgctgcactatgtactaaaggtttacctaacaaaacagctgcatcattaagaaataactttgtagccagacgatctgtacaatcgacaacaacatccacattcttaaacacttcctcgaaatttttaggcgtaacaaaattatttaacacttgaacattaacatcagagttaagtgattttacaaactcctgtgcttttatcactttactttgattgatatcactctccttataaatcacctgtctattaaggttggacatttgtattttatcatcatcacacaatgtaatatggccaataccactagcagcaagtagaggaataactgtacttcctaagccaccacaacctattatcaaaacattactttcacttaatttactttgacctactttgcctatctctgaaataagaacttgtttcttataacggtcaaacactaattttcctgtaaatacctactacctggaactgatacaggtatctttcgcaaatattctggaacatcttcatctacataacttttaatatttaattcaactaaactaattataggaaaaggtagtttaatatccctactacgtttaactaaagctgcacctgcaacaacagtaccaccattcttctttacacaacttactacttccatagaagtttttccagttgtaatcacatcttctacaattaaaactttacttcccttttttatttcaaacccccgacgcagtgtaaacagtccattaacacgttcacagaacacattattaatacccaactgcctagcaatttcatagccaactgtaatagctccaactgctggagaaactataagatctatatttggtaaaactttaccaatctttgtagcaagtaaagcacaaaacttcaccgcaataactgggttttcaaataacctagcacactgaatataagtatcactatgtaatcccgaagataatacaaagtgaccacttattattaccccaattttagtaaattcaccatatatagaatcactatttaataaatccgcttccataacaaaacaccttaaaaaactgtttcttctacttcatgaagattatcattaacctctgcattgaaacaactaacttcattatcacttgcaagtatacttcttatcttctgttctatttcatgtgcagtatcacaattagctttaagataagattttgcattttctttaccttgaccaagacgcacactattatacgagtagtatgacccagctttttcaataatattaagttttacacccatatctataatctctcctacctttgagataccttcattatacatgatatcaaaatctacttgtttaaaaggaggagccaccttgtttttaacaactttcaccttagtttgattaccaataattacgtccttatccttaattgcacttaccttacgtatatctaatcttacagaactataaaactttaaagcattgccaccagtagtagtttcaggatttccataaactacccctattttcatacgtatctgattaataaaaataagaacacaattagcttttgatacaatagaagttaacttcctcaatgcatgacttaacaacctagcttgtaaccccatatgttgatcacccatatcaccttctatctctgctctaggagttaatgcagccacagaatctactactattacatcaatagcaccagaacaaaccagatactcaactatatgtaatgcttgttcacctgtatcgggttgagaaacgatcaaatcaccagtatttacccctaatttgcgagcatacatgatatccaaagcatgttcagcatcaataaatgcacaattcccaccctttttttgtgactcagcaattacatgcaaagcaagtgttgttttaccagaactttcaggcccaaaaatttcaacaattctacctttaggaaacccaccaatgcctaaagctgtatcaagcgcaattgatccagtagaaatactatctattttttcaatagcaccttgttttaatttcattattgcaccacgaccaaaagccttttcaatttgactaattgcgctatccaatgctttttgtctttcctggtttaaatttttgctatcagacatatgataaatactttataaattaaaaaagctaatcactcttaatattaattgtcaagttataaatcattgcaccatttatttcaaacaaaccaaatttaaacattcacaaaaggttcttctatcttaaaaatcatggaataattatcaatgacacaaacttaattagtataagctcaaatcataactatcaacacctataaaactagcaactattttcacctaaaatgttaaaaataagattttatcctcattcatttttttcatagcgaagtataacgttacaattcatttcaaaattgcaatacttaagtatcataccaatataaacattacacaaagttctataccttgtaatcaaaggttaagacttatcataattatctgcacttataaaatttactatattatctgatgtccctttccataaatcaaaactacctgtaacatagcgttgaatatatactgttttacctgtatattcgtaaataaactttactatatcatcaacattaacaacgttgttatccttaagagtaaggacaacctttacagacataccagacaacactttcagtgctgttaatgtatgacttatgctgcctagataagagcctataaccaaaatcacattaatatttaaatcccgtattatatctaaacaagttttatcatctgtaataggagacataactccacccactccttctattaacaaataatcatgagcctgactaatacattgggaacaaaatgtcacaattttattatagtccaatttagtattttctaacttagcggctatattaggagcatgtggataatacaacctccaaggtgaaactttcgttatattactatcatgacaatccatacttaaactacacagtattttacctgtatcattatctaaaatattcgcatcactccacccactaataacaggttttattgcatgtactaccttataacttttacttaaatgccaacacagggctgtcataataaaagtttttcctatatcagtaccgcaagatgtaataaaataagctgacatttacacaacaaccaatataatttaacaaacgtatcctaactgatacaaacccagttcacaatattttagaaacaagggcaattcaatatgacagatgcaactaataaaggatttttcagcaatatcaagaaaggtttatttaaaacctcatcaaagttaagtgacggtataaagaaaattttttctagtggaaaaaaagttgaccaagaaactttagaagaattgaaagaattactcatcacagcagatgtaggctatgacaatgcttcactacttacacaaaaacttgcatccacaaagtttaatgaaatggatgataatacagtaaagcaaaaactcgctgaatctatagaaaacatcctattacaagttgaaaagcctctctctataaacaataagccacatgtaattatggtatgtggtacaaatggaaatggcaagaccacaactataggtaaattagcacataggtttaaaaacacagggaaaaaagtactagttgcagcatgtgacacatttcgtgcagcagctactgaacaactaatagtatggtcacaaaaagtaaatttcccagtagtaacaggcaatcagggagcagatgcagcaagtatagcatatcaagcaatgcaacaagccttaaatgaacaaaccgatgtcttgctaattgatacagctggaagattacataatcataaaaacttgatggaagaactagcaaaaattagaagaattataaacaaacatgacaacaatgcacctcatgatgtcatactaatattagacgcaacaactggacaaaacgctgtcaatcaagttgatgcttttttacaattcgtcaatattagtggattaattataactaagttagacggcacagcaaaaggaggagtagttataagaatagcacaaaaatataaattgaacattcatgcaataggtattggtgaatctgtagaacaacttcaagacttttctgccaaagaatttgctgcaggattactcgacataaacaccatataattgtagtcacttaataaactgtctaatattcagccatatcagcagagtagtcataagaatagcacaaatataaattgaactcatgtataggtatattgatgaatctgtagaacaactttaagacttttctgccaaagaatttgctgtaggattactcgacataaacaccatataattgtagtcacttaataaactgtctaatattcagccatatcagcagagtagccataagaatagcacaaatataaattgaactcatacaataggtattggtgaatctgtagaacaactttaagacttttctgctaaagaattcgctgtaggattactattcgacacaaacatcatataattcaaatagttactcaataaactgtgtaatactcattatacacatgaaaaccagattaacgtttacaagtccactgcatttaccctttataagccacgttaaataatatgctcagatgtaattatcctgtattcgaacactttcataactattacatataccataacacaataactactacaaaaattattaatcaccttccagactatcctcgcaatcaatgttggaacagtaaatatgttcaataacaaataccctttatctgaaattctataacaactacaacattacactattgctaattatttcttactaaaaagaaattcatattacattaacaagctactaacttattttttaatctaggttaaaagcaacacgtataacaacaatcattacatagtaaaaaagccaggttgatcattatataagtataatttttccatttttactacatctattttcttttgctctatgtcaaaaagcaactgattaatatgctcattcatgattttatcatctttacttttcatgtaaaacctacaacatacctgatccatataagaaagatttacactcacagattcatcaggccaaatttctaatcctttattatgaattagcacaagctccagtttatcatgtgtaatattttgaagattattaattaactgcttaaaatctagtcctacaccatcacaaccaatagtaatatccactcctacaagaactctagtaacataagatggttcatatgtataagatacacccgtcctatctacattatcctgaaacattgattttggtaattgagatggagattgtccaaaattttcaacaacagccttagcaaaatccattgtagaaacttttttcttgctaacctgactttggtaaatatctgctgtatgaataccatcttctaaagttttaagaaatgcattataaattagctgtgccttgtcaaactgttttaaatacatcaacatttgtatagctgcattaagtaatccagaaggatttgctatgttctttccagctatatctggagctgaaccatgaacagcttcaaacattgcataattattccctatattagcactacctgcaaggcctatagaccctgataattcagcaactatatcagacactatatcaccataaagattagtagtaactataacatcaaaattttcagggttagaagccacttttgccattccaatatcaacaatataatgatctgattcaatgtcaggataattctctgcaatctttgaaaaagacttatgaaaaattccatctgtcattttcataatattatcttttatcaagcaagtaactctcttcctattatgaaccttagcatagtgaaatgcataatcacatattctttctgaacctgatctcgtaataacttttgagcattgatacgtatcattagtcagcctatgttctataccagtatatgtatcttcctcattttctcgaactatcactacattgagattaggataccttgtctttatcacaggatgataagaaatacatggcctaatatttgcatacaaccctaatctctttctcaacgtaacattaagacttttatgcccacgaccttgtggagtcatggtaggagacttaagcagtactttcgttctataaatagaatcccaagatgaaggcgcaataccagaagaccattcttttttatataaattgtgtcccacctctatagtttctacaactagacctgattctgcttcactcaagatcaatagtacagcttccataatttctgggccaataccatctccataagcaactgttattggaattgacattatacttcttccattttcaacaataatatagtatatcttccagactaaaaaatttgattatatagacaatataatattaaaaacaacaaaaatatatcaaacatgtctatatctaataagacgatataagacgttaaacaatttgctagtaccgtcatcaaccaaaatttatgctcttatcaaaacaataagtcacataaatatgatcatcataatctacattcattaatttatatcagttaacaaagcaagcatctgttctctttactattttatattactaataatcttctttacaaaatcttaaaattataaacacaaacacactaaaataatgttatagtaagtataaaatagcagtgttataatacatatttttagttaacacagtatgctacattgcaatttggaaaatttagaatacattggggtaacaggtgcactatggaagccatataatgtaaacttccgtgatgttttaacaataacacaaaaacttggtatatctgaaattgttgcaagagtattatcaacaagaaaagtaaatatagaagagatcaatgactttctatatcctacactaaggtcatctttacctgatcctttccatcttttagatatggacaaagcaatacagagaatttgtcacgcaatatataataaagaaagaattgttatttttggagattatgatgttgatggagcaacatcatctgcattaataaagcaatacttaacacaaataggtgtacctacaacaatatatattccagatcgtatatgtgaaggatacggaccaaacactcaagccttacttaaattacaagaaattgggcacagtttatgcataactgttgattgtgggactatagcacatgaaccaatatccgtagcaaaatctgtaaatcttgatgtgatagttatagaccatcatatgggcttgaacactttaccagatgcaattgcagttattaatcccaatcgcctagatgaaaattctccatatacatatttagcaggagttggtgtatcatttttaatgcttgtagcactaaataaaactttaaaagaaaaaggattttttacaaataacaacgaaccaaatttaataaactatctagatttagtagcattgggaactgtatgtgatgtcatgcctattataggattaaatagagctttcgtaaaacaaggcttaaaaattatggcaacaagacaaaatataggccttaaagtcttgtctgatgttattggtttagaagataaaccaaatacttaccaactaggatttaatataggtccacatattaatgctggaggaagagttggaaacgcaagtttaggagcaaggctattatcaagtaatagtgaagaagaagctctagaaatttcagaaaaattacaaaactttaatctagaaagaaaagagttagaacatagaagtttcaatgaagcagtagaacaagcagaagctctaatatcaacaaatacaaatttaattatagttgcaggaaactggcacccaggaataataggtatagtcgcaggaagacttaaagataaattttttctaccaagcatagtaatttcactggataagggcattggcaaagcgagcgctagatcaataccagatgtagacttgggtgcagccattttatcagcaaaattagaagggatcatcactgaaggaggaggacatgccatggctgctggattctcaatacaggaagataaaattaaaacattaaatgaattcctttcacaaagatttcacaatattaataaacaaaaagtatttaaagtagacggcattattactgcagcagcagttaatctaaccttatggaaagaattacagtttttagaaccctttggcataggcaatcctgaaccaaggtttatcctgacaaatatcaaaataaaaaatccggagattataggagatagtcatataagatgtttaattcatgacaacaaaacttttataaaaggaatttgtttcagatgtacagacacagaattgggcttagctctattagaacgtactgcaatcatgttactaggaaaaatcagcgttaactattggaaaggcaatgagaacatacagtttataatagaagatgcgattacaaaaagtcacaatgatcacaaattataaagattataggaatactcaacacaaatgttgttattggtagataaattcaataatacataacctttacaatctacaaggacattaaatagcaaaaatattacaacagtttttccttaataaatgatctttaaattagtatatatttcatactattggctgtaaatatatactctcacatctacatatttctatagatataaagctaaataatattaatttcatgtaacaataaccattcacattatattatacaaacaatcaaaaaattaatagaaaaacaatgatcttttaattagtatatatttcataccattagctgtaaatatatacgctcacatctatatattcctacagatataatagctaaatgatatcaatttcatgtaacaataaccattcacgttatgtacacaaataattaaaaattaataggatttaaaaaaacaatgcaatactatcagtatttgtttaacattttactgtttcaacaatctaacgttacaaatgtacgatgactttataaataatgagaatattctgttaatcataaatgcaataaaaaaatttcaaggagatattaggttagtaggtggatgtgtaagagatagtcttctaaaaagacagaccatagatattgattttgcaactactttattacccaaccaaacaataaatgctcttactgcagctcatattaaagctattccaacaggtataaaacatggtacaataacagccttagttaataatacagcatatgaaattacaacactaagatctgatattagctgtgatggaagacatgctgaagtaaaatttacaaacaattggcagcaagacgcttcaagaagagatttcaccttcaatgctctatattgtgatgaaaaaggaatagtatatgattatttttctggtatccaagatctagaaaaaaaacatctaaattttattggagatccagaaattagaatacaagaagactacctacgcatacttcgagcatttagattttatgcttctatatgtagtcaaaacaaattgagtgatgaaatagtgcactcttgcacaaaatattcatcttatatcaataacctatccagagaacgcattcgcgatgagttctttaaacttttattatgtcctaacttatcaaacacattaaagattatgcaaaaatgccacgtgctagataaaatcattccctttgaagtcataccagacataatgtcatctgagaccttatcaaacacagatccactaacaaaattagcagctcttttaagaacaaacaataacaaccactctctagataaaattaaagcttctttatgcttatcaaactacagtcaaaaaacacttgtgtcactattaaacaataatttagaacttccactttcaactaccgcacaacacaaacacattaacaagcttggaaaagaaatatactgcaatctactgagaataatacatgcagaattaaatttaaattatcatgacctaatgcaatatatagagtacgcagatcaattaattattcctgaatttcctatctctggaaaagatttacttaatataggataccaaccaggaaaaaatcttggtatcactttagaaaaaatcaaagatctatgggaaaatagttcatatcaactaacaaaaacccaattattagattacgcgagaggaaaattattaaaaagtaagaattaaatctcgtactatcttcaaaaaattacataagataaaaacattttattgcaaactgtattttacaagaaattacatagctatttccaaacacactaaaatatattcttttcctatcgaagaattcataattcttcaaaggaacatttaaaacaaatataaactcaaacttattgcacagaaatcaactattacacttaaaagtataaacaatataatattctatttatacaaaagccatttcattaagatatcatatctaaattgatactttttacataatcacccaactatcacctgtatatacaacaaactaaaattgacagataaacaacagaagtactttaagtaataaatacttatattacaacaaaccaaggtacctgaacttaaaataacaacatgttattataaattcaggctttaacatgaatatatttcaatacaggtaattacccatttaacgctaggagctcatagtcactaaagaaaaatcttatttctctcatggcattatctaaactatccgaaccatggacacaatttgcatctatattctcagcaaaatctgctctaatcgttccaggacttgcttttttaggatctgtagcacccataatttctctatataagcttatagcattttctccttgcaacacttgcactattattggaccagataccataaaatcaattagaggtacaaaaaaatgttgagatttatgtatcgcataaaattcttcagcttgacaacgtgttagtaaacacatcttttgtataattattttaagtcctgaattttctatataagaattcacctgcccagtaatattacgctttatcacatctggttttaatatagacaaagttttctctaacaaaatacatccccccttacccggacaaactgactttcatgtttaatataaattattgatccaatcaagctaaaaagtaaataaattttatcttatatttcataaagcataatatgttatttctgtatattatataattagtatactattccagcaaactagatagaatatatccattaaataactattgcattcactttatgcatgatttatcttacataggttgctttgttataggaaaataatatgtctacacatgcgaaaaacaaaataaataaaatggaagatactgatgaaataaaagcacatgatcctttaattgccggtttgatcgataaaaacatgcagaaaaacaaatttacaaataaaggagtaaacgacaatcatacttccaaaaatttcacaaaagaaggagtagaatccacaaaagatctaaaaaatagcacaacaaaaattaggcctcaccctgttgatgagtgcgttgggaaagaaataaaaagacaacgtatcatgagaggtatgagtcaaaaccagcttgcaaacaaattaggaatcactttccaacaagtacaaaagtatgaaaaaggaacaaaccgtatagtgattagcaggctatatcaacttgcaagcgtacttaacgttgaagtaagagatataatgttaaagttacaggaagatctaaaaaatatttcatgtgatcacactgttgcatctacatctactcttaaagataacgaggaaaagtttataccagagtttcacgatagcaaaatagatagcaaagaagttttaatgatggttagagcatatacttgtataaaaaatgaaaaagtacgtaacataatttacaatttggttaaggcattgtctttagataacaaacagtaagttataaaattgtatcttatatatacaagtatgctaataaattaaagctttcataattgtaatgcattaacaatgatttattttataatattaacctataagtaaaccaggtattgtcattcagtatattaataaggttttatttgtatattattgaagtattacttttgacttgaagcatgattttaattaatatgaaactgttctatcatttggataatattatgactaaattctcagctataggaattgtactttctctagtaacattattcgcatgtaatgtatttgcatcaccgattcctattgatttctctaatgaaagcgaaacagctgggttttacgcaagcggacattacaacatacagttccctagatttagtccaatatccgtcaaatataaaacagatgaaaatacagaaaaagaactaactctatttacattaaaagaaagtactgatactccaactttcaaacagaaaagtgagttcaacgacaaaaaaggttacagccctatatacaatagaaattatacaggattttcaggagctatcggatattcaggaggaggtcttagagttgaattagaaggagcatttacaagatttgatgtcgataaacaaaaatataaaaaggataactatagatattttgcattatgtaaaaaagatagtatagagagtacagataacagtaatggcaaccatgtcgtcatgaaaaatgaaggatttagagttatttctttaacattcaatgcttgttatgatatgatagttagtaattcctctttagtgccaagcgcttgtattggtatagggcaaggaataactaactttttaggaggaacaaacatccataccctatttaaagcaaaactaggcttagggtttctaatctcaccaaaaactgttatattcgccaatgggtattatgtaaaaacaaaagacaattctttcactaacctatcagttcagtacccccttgaacttaaagaagcaccaaaacatatagaccctatagcttgctttaatgcagacaactatggtggtgaagtcggtcttagatttattctataatctgactatagcaacatattaacaacaacatagttttagtaaagctaattctactataaagtaagttctgtgtacatagcatattctcacgttataataactttatcacgtgatataaaaataaaacaggtgatagcaggaaaactatcctatcatggcaaacttatattagacacttatcaaaaacaatttaagaatccataaatgaaatttgttcttaaatacacatttacatgttatgtaatcttgttttatactttataaatttgttttttatttgactaaatattttttatagaataaaacaatcattgtgtattaccgtttcacatttataacaaatgcttaaattatgccgtaaacataacaatcgattattagttttgttgacttaattcttttttagtatatttattttgctgtaagtgtgtggttctttaaaaacaattattaaggtttaggtgtatgagtaaaaggagtaacagaaagtttgttttgtgggttatgttaatattatttacaccacatatttctttagcatcagttttaaatgaccataattctatgtatgttggtattcagtacaagccagccagacaacacctatcaaaacttcttataaaagaaagcgcagccaacactgtagaagtttttgggttaaaaaaagacttactaaatgatctattaactggtattaaagataatactaattttaatataaaatacaacccatattatgaaaataatcgtttaggtttttccggtatatttggatattactataacaaaaatttcagaatagaatctgaactttcttacgaaactttccacataaagaacaacggatataaaagaattgattgtgaaaagcattttgctcttgcaaaggaaataagcggtggtagtaacaatcctgccaataataaatatgttaccctaataaataatggtatttcacttacctcagctctgatcaacgtttgttatgatgttgacggacttaaacataatataataacgtattcatgtttaggatttggagtagacacaattgattttctcagtaagtatactacaaagttttcataccaaggaaaattaggagctagttatactgtttctcctcaagtatcggtttttatagaaggttattatcatggtttatttggtaaaaaatttgagaaaattcctgtaaattatccatgtgactatccatcaccaacaccaccaaacagcaagccacatgttcacactacagcattagctatgttaagtattggatattacggtgggagtattggaataaagtttatattataaaaatattttttgacaaatttatatttgtgtttatatgtatataggtatataataaagttttagtgtgtctattgctcattaagtgagtgtgttaaaagggttatgcatgaataataaaaaatcaagaggtcaggtcttattatttgcagcttatagcatctttaagtatattaatagctgcacaagtaagtttaggctaagtgtaaaatgttttgtttataatcctttaaagtatttttattacaaaagcactttcttaaaactaggaaaatttttcgtaaattacaactatagtaaaacatcaaattacctacataggagtttattcaaactttttggtattataagaacaaccaattttaaaatttcttatttaaatttttttactaaccctagagtattgataatatactataagatactaaaaaataagtgtaacaattcttccatcaattatcttttgaataagtatactatcaatcctacagcaactagttttatcaatagtgttattatagggatataccctggttttgttaattataattattaaggttatattatgagctatgcaaaggtctttatattaatatgtttaatattgcttgtgccttcattatcctttgcaattgtaaacaatgatttcttaaaggacaatataggtcatttttatataggaggacaatataaaccaggtgttccacgttttaatagatttttagtaactaataacaacataagagagctaatgtcctcagatgaagagtgtagaagtactatacctcacatggtgcaaagtgtagcacaaggtactttaccacctgaagcgttggaagagcttgcaaaaggattgctacatggaggttatcttttttttactttaccttataaccctacatacaagaaaaatttattaggtgcaggtggtgttatagggtattcaaccactcattttagagtagaagttgaagctttttatgagaagttcaatttaactgcccctgcaggataccttcataaaaatttttacgagtattttgctttagcaactacaatggatactaaacatccacatcaatctgcagaagataaatattattatatgaaaaacacaggtattactttatcaccttttataattaatgcatgttatgattttattttaaaaaagacacgcaatgtagctccttatttatgtcttggggttggtggtaattttattgattttctagatcaagtaagctttaaatttgcttatcaagctaaggttggtattagttattttgtttctccaaatatagcattctttattgatggatcttttcatggacacttaaataatcaattttctgatttgccagtagtagattactcatcttccgggttcccaactatatcagcaaaatttaacgccaattttcttactagcagtatcggaatcaggtttatttcttaaatagtaggtcgtatttatgcagaagttatatataagttttataatattatctgggctgttattgccaaagtatgttttttgcatgcaccaaaacaacaatatagatggatcttatgtaacaataaaatatcaattaaccactccacattttaagaatttctatattaaagaaactgattttgatacacaagaaccaattggattagctaaaattacagcaaacactaaatttgatactttaaaagaaaattttagctttagcccactacatcaaactgattcttataagtcctatcaaaatgatttattagggataggtttgtctgttggactgtttgtaaaaagttttaggatagaatttgaaggagcatacaaaaatttcaatacaaagcgccttgcacgttataaatccaaagacgggtataaatactttgctataccacgtaagtcggagcatgggtttcttgacaatacctttggttacactgtagcaaaaaacaatggtatatctattatatctaatataataaatttatgtagcgaaacaaaatataaggcctttacaccttacatatgtataggcgttggtggagattttatagaaatttttgatgtcatgagaataaagtttgcttatcaaggtaaagttggtgttagctatcccattacttcaaagttaattctctccattaatggacagtatcataaggttataggaaacaaatttgaacttttaccagtttaccaacctgttgaattaaaaagactagttacaaacaagactagcaaagatatagatcaagatgtcactgcatcattaacccttaatctagaacattttagcagtgaaattggattaagttttatattttaaagtgaaggaaatatgtatatgtataacaaaaaacactattgctatatagtaacatatgttataacactattctttctattgttacctatagaatctttgtcagcattaataggcaatgtagaaaaggatttaaaagtttctagtacatatgtcagtagtcaatataaacccagtatttttcactttagaaatttctcaatacaagaatctcaccctaaaaaaagttcagaagaattcaaaaaaataaaggctaatctaaataatatactcaaatcaaacgcttataacctacagtttcaagataataccactagttttagtggaaccattggctacttttctaagggactaagacttgaagcagagggttgttatcaagagttcaacgtaaaaaattccaataactcactaataataagttcaaataaataccattctagaatacatgatgaaaattatgctattacaacaaataataaattatccatcgcatctattatggttaacacctgctatgatatttcaattaataatacatcaatagtaccgtatttatgcacaggcattggtgaagatcttgtagggctttttaatacaatacattttaaacttgcatatcaagggaaagttggaatgagttatttgataaataacaatatcctattattttctgacatatattatcataaagtcatgggtaacagatttaaaaatttgtacatgcaatatgtagctgatcctaatatttctgaagaaactatacctatattagcaaaacttgatattggttattttggaagtgaaattggaataaggtttatgtttaactaagtaaggttatatactatgacaaagaaatttaattttgtaaatgttatattaacatttttgttatttcttttcccacttaagtcatttacaacatatgcaaataataacacaatcactcaaaaagttggattgtacataagtggtcaatataagccaagtattcctcatttcaagaatttttcagtagaagaaaatgacaaagtagtagatttgataggtcttacaactgatgttacatatatcacagaacatatattacgagataatacaaaattcaacactcattatattgcaaagttcaagaacaattttataaatttcagcagtgcaattggttattattctgggcaaggaccaaggttagaaatagaaagctcttatggggattttgatgttgtaaattataaaaattatgcagtacaagatgttaatagatattttgctttagtacgtgaaaaaaatggttcaaatttctctccaaaaccacatgaaactagtcaaccctctgacagtaatcctaaaaagtctttttatactttaatgaagaataatggggtatttgttgcatcagtaataatcaacggttgttatgatttttcttttaataacacaacaatatcaccttacgtatgtataggagttggaggagattttatagagttttttgaagtaatgcatatcaagtttgcttgccaaagtaaggttggtattagctatccaatatctccctctattactatttttgctgatgcacattatcacaaggtcataaataataaatttaacaacctacatgttaagtattcatatgaacttaaaaactcacctaccattacctctgcaacagccaaactaaacattgaatattttggtggtgaagttgggatgagatttatattttaaataatcaaataaggaatttttatgagcaaaaaaaagtttattacaataggaacagtacttgcatctctattatcattcttatctattgaatccttttcagctataaatcataatcatacaggaaataacactagtggtatatatattacagggcagtatagaccaggagtatcccattttagcaatttctcagtaaaagaaactaatgttgatacaatacaactagtaggatataaaaaaagtgcgtcttctatcgatcctaacacttattcaaactttcaaggtccatatactgttacatttcaagataatgctgctagtttcagtggagcaattggatattcttaccccgaaagtctaagacttgaacttgaaggttcttacgaaaaatttgatgtcaaagatcctaaagactactcagcaaaagatgcttttaggttttttgctctagcacgtaatacgtctactactgttcctgatgctcaaaaatatacagttatgaagaataatggcttatctgttgcatcaatcatgatcaatggttgttatgatctatcttttaataatttagtcgtatcaccttatatatgtgcaggtattggtgaagatttcattgaattttttgatactttgcacattaaacttgcttatcaaggaaaactaggtattagttattacttctttcctaagattaatgtatttgctggtgggtactatcatagagttatagggaataaatttaaaaatttaaatgttaaccatgttgttacacttgatgaatttcctaaagcaacttctgcagtagctacacttaatgttgcttattttggtggtgaagctggagtaaagtttacattttaaataatatgtgggcagttctcatatgatatataaagaaaaacttactagagtgggagaatatatcttagcatatttatcatttattctttctacttatatctttctagtgctggtaaatattattagatataacagccttgctatatgtgttatcagtctactaagaactaatatctttaacgttagcacaaaaaaattaataaaagataaatgtcgtgatactaagtttagtaacatgaattgttatttgtacggtaaaccgttaaatttacaaattttttatggaatattttcctttattagaaactttcaaaataacacactaataattcctaatgatagtaaatgcggcttctataccacgttatgggataatccagcactacattatacatatacacttactggcagtgagtaccgtaatttttttgacattctatatgaaaacattatctgtcaatgtaaattacttattaactataaccgttctgtattaaaccaacataataaaaatactctcgtaataataccaatacctaatgctagagagttcagtaatgaaattcgagtaaggaatatatcaataaataaggaaagttcttatgagtgctaaaaaaaagctttttataatagggtcagtgttagtatgtttagtgtcatacttacctactaaatctttgtcaaacttaaataatattaataataacactaagtgcactgggctatatgtcagtggacaatataaacctactgtttctcactttagtaatttttcacttaaagaaacttatactgacactaaagagttattaggactagcaaaagatattaagtctattacagatataacaacaaataaaaaattcaacattccttataacacaaaatttcaagataatgctgttagcttcagtgcagctgttggatatatttcccaagacagtccaagggttgaggtagaatggtcttatgaagaatttgacgttaaaaatcctggtaattacgtagtaagtgaagccttcaggtatattgctttagcaagaggaattgataatcttcaaaaatatcctgaaacaaataagtatgttgttataaagaacaatggcttatctgtcgcatccattataatcaatggctgttatgatttttctttaaacaatttaaaagtatcaccttacatatgcgtagggtttggtggggacattatagaattttttagtgctgtaagttttaaatttgcttatcaaggtaaggtaggtatcagttatccattattctctaatatgattatatttgctgacggatattaccataaggtcataggaaataaatttaacaatttaaatgttcaacacgttgttagtcttaacagtcatcctaagtctacttttgcagtagctactcttaatgttgagtatttcggtagtgaatttgggttaaaatttatattttaaggagttttatgagtaaaaaaaattttattacaataggagcaacacttattcatatgttgttacctaacatatcttttccagaaactattaacaataacactgataaactttctgggttatatataagtgggcaatataaaccagggatttctcatttcagcaaattttcagtcaaagaaatctataatgataacattcaactaattgggttaagacacaacgcaatttctactagtacccttaatattaatacagattttaatatcccctataaagtaacatttcaaaataacattaccagctttagtggagctattggttattctgatcccacaggggcaagatttgagcttgaaggttcttatgaagaatttgatgtgacagatcctggagactgcttaataaaagatacctatagatatttcgctttagctagaaacccatcaggttctagccctacctcaaacaactatactgttatgagaaatgatggtgtttccattacttctgttatatttaatggctgttatgacatctttttaaaggatttagaagtatcaccttatgtatgtgttggtgtaggtggagattttatagaattttttgacgcattacacattaaattagcataccaaggcaagttaggtatcaattatcacttatcgactcaagcaagcgtatttattgatggatattatcataaggttataggaaatcaattcaacaatctaaatgttcaacacgtggctagtacagattttggacctgtatacgcagtagccacacttaacattggttattttggtggtgaaatcggaattagacttacattttaaaggaatattatgaataatagaaaaagtttttttataataggtgcatcattactagcaagcttattattcacatctgaggcctcttctacaggaaatgtaagtaaccatacttattttaaacctaggttatatatcagtggacaatatagaccaggagtttctcattttagcaaattttcagtcaaagaaaccaactacaatactactcaactagttgggcttaaaaaggacatcagtgtcatagggaacagtaatatcacaacctacacaaatttcaactttccttacattgcagaatttcaagacaatgccataagtttcagtggggcaattggatacttgtattccgagaattttagaattgaagtagaggcttcttatgaagaatttgatgttaaaaatccagaaggatctgctacagacgcatacaggtattttgcactagcacgtgctatggatggcactaataaatctagtcctgatgacacaagaaaattcactgtcatgagaaatgacgggttatcaatttcatcagtaatgataaatgggtgttacaattttacattagatgatataccagtagtaccgtatgtatgcgcaggaataggaggagatttcatagagttttttaatgatttacatgttaagtttgctcatcaaggcaaggtaggtattagttattctatatcccctgaagtaagtttatttcttaacggatattaccataaagtaacaggtaacagatttaaaaacttacacgttcaacacgtaagtgatttaagtgacgctcctaagttcacatctgcagttgctacactcaatgttgggtactttggtggcgaaattggagtaagatttatattttaattataactaaatacggaagatctaatgaataaaaaaaacaagtttattatagctacagcattggtatatttactgtcattacctagtgtatcgttttcagaggttacaaacagcagtattaaaaaacactctgggttatatattagtggacaatacaaaccaagtgtttctgtttttagtagtttctcaattaaagaaactaacactatcacaaaaaatcttatagcgttaaaaaaagatattaactctcttgaagttaacgccgatgctagtcaaggtattagtcatccaggaaattttactataccttatatagcagcatttgaagataatgcttttaatttcaacggtgctattggttacattactgaaggtctaaggattgaaatagaaggttcctatgaagaatttgatgctaaaaaccctggaggttatggtctaaatgatgcctttcggtactttgctttagcacgtgatatggaaagcaacaagttccaaccaaaagcacaaagctcacaaaaagtatttcacactgtaatgaagagtgatgggttatctataatatctatcatggttaacggctgttatgatttttcttcggataatttattagtatcaccttatatatgtggaggtataggtgtggatgcaatagaattttttgacgcattacacattaaacttgcgtgccaaagcaaattaggcatcacttatcaattatcttataatatcagcttatttgctgatggatattatcatcaagtaataggtaaccaattcagaaatttaaacgttcaacatgtagctgaacttaatgatgcacctaaagttacatctgcagttgccacacttaatgttggatatttcggcgctgaagttggagtaagatttatattttaattacaattaaatacggaaaagttcatgaatcacaaaagtatgctctttacaataggtacagctttgatatccttattgtcattacctaatgtatcattctcaggaatcataaataacaatgctaacaatttaggtatatacattagtgggcaatataaacccagtgtttctgtttttagcaatttctcagtaaaagaaactaacttcactacacaacagttagtagcacttaaaaaagatattgattctgttgacattagtaccaatgctgatagcggtattaataatccgcagaatttcactatcccttatataccaaaatttcaagacaatgctgctagttttagtggagcacttggattcttctacgctagaggtttaagacttgaaatggaaggttcctatgaagaatttgatgttaaaaaccctggaggatatacaaaagtaaaagatgcatatcgttactttgccctggcacgtgagatgcaatctggtcaaacttgccctaaacacaaagaaacatcaggtattcaacctcacggtatttatcacactgttatgaggaatgatggggtatctatttcatctgtcataatcaatggttgttataactttactttaagtaatctaccaatatcaccttacatgtgtgtaggtatgggaatagatgctatacaattttttgattcactacatattaagtttgcacatcaaagtaagttaggtattacttacccactatcttcaaatgttcatttatttgctgatagctattatcataaagtaataggtaataaatttaaaaatctaagggttcaacacgtttatgaattacaacaggtacctaaagttacatctgctgttgctacacttgatattgggtattttggtggtgaagttggagtaaggtttatactttaattataactaaacacggaaaatttcatgaagaagaaaaatcaatttatcacaataagtacaatattagtatgtttattgtcattatctaatgcatcactttcaaacactacaaatagcagcactaaaaaacagtttgggttatatgttagtggacaatacaagcctagtgtttctatttttagcaatttctcagtaaaggaaactaattttcctacaaagtatctagcagctcttaaaaaagacattaattctgtcgaatttgacgatagtgttactgctggcattagttacccacttaatttcagtactccttatatagctgtatttcaagataatatttctaattttaatggcgctattgggtacacttttgttgaaggcccaagaattgaaatagaaggttcttatgaagaattcgatgtcaaagaccctggaagatatacagaaatacaagatgcataccgttactttgctttagcacgtgatatagactctattcctactagcccaaaaaatagaacttcacatgatggcaacagttcatataaggtataccacactgtaatgaaaaatgaaggactatctataatatccattatggtcaatggctgctatgatttttcttcagataatttatcaatattaccttatgtatgtggtggtataggtgtaaatgctatagagtttttcgatgcattacatgttaaattcgcgtgtcagggtaaattaggtattacttatccattatcttccaacgttagtttatttgctggtggatattatcaccaagtaatgggcaaccaatttaaaaatctaaatgttcaacatgtagctgaacttaatgacgcacccaaagttacatctgcagtagctacacttgacattgggtattttggtggtgaaattggagcaaggcttatattttaattataaacaaatatggaaaatctcatgaataagaaaaacaaattctttacaataagtacagcaatggtatgcttattgttattacctggtatatcattttcagaaactataaacaacagtgctaaaaaacagcctgggttatatatcagtgggcagtacaaacctagtgtttcagtttttagtaatttttcagtaaaagaaactaatgttcccacaaagcagttaatagcacttaaaaaagacattaattctgttgcagttggtagtaatgctactacaggtattagcaatccaggtaatttcacaattccttatactgcagaatttcaagataatgttgccaatttcaatggggctgttggttactcttttcctgatagtctaagaattgaaatagagggatttcatgaaaaatttgatgtcaaaaaccctggaggttacacacaagtaaaagatgcgtaccgttattttgcactagcacgtgatttaaaagatggcttctttgaacctaaagcggaagatacaggtgtttatcatactgttatgaaaaatgatggattatctattttatctactatggttaacgtctgttacgatttttctgtagatgaattaccagtcttaccttatatatgtgcaggtatgggtataaacgccatagaattcttcgacgctttacatgtaaaatttgcttaccaaggcaaactaggtattagctatcaactatttactaaagtaaatttattccttgatgggtattaccatcaagtaataggcaatcaattcaaaaacttaaacgtaaaccatgtttacacacttaaagaatctcctaaagtcacatctgcagtagctacacttgacattgcatactttggtggcgaagttggaataagattcacattttaattgctcaaccataaaataatgggaaattaccttttctaggaagtttctcattatttaacagttaactttctgtaaacttctaataacagtattttgttcactcttccccttaataaaaatcataagtttacaataatgtcaaaaagatttctttttaaacacatttaaaatggctaaaccgttttctgctttattagaatgattcccaaataaattttaattaattactgttccgtatttattaatatatgttataatgtaattaaataaggatactagatttgctcataatgcatgtactgaatttgtgatttgaaataacaagacttaaatgtcgaatttagcttctgtcctagtggataagtactttagcaagtggtaaaagcaagtctactcatatttttattaattaagtagtaaagttaactatagattttattaaaatttttattctaatcactttaaatatcaattacttttgttgtaaatttgaaagaaattttatattctagacttgcttttctttatttctttcattattcttaaatttttattatcttttataaaaggtttattaacatgaattacaagaaaatttttgtaagcagtgcattaatttcattaatgtcaatcttaccttaccaatcttttgcagatcctgtaacttcaaatgatacaggaatcaacgacagcagagaaggcttctacattagtgtaaagtataatccaagcatatcacacttcagaaaattctcagctgaagaagctcccatcaatggaaatacttctatcactaaaaaggttttcgggctgaaaaaagacggagatatagcacaatctgcgaattttaacaggacagatccagccctcgagtttcagaataacctaatatcaggattctcaggaagtattggttatgctatggatgggccaagaatagaacttgaagctgcataccaaaaatttgatgcaaaaaatcctgacaacaatgacactaatagcggtgactactataaatactttggactatctcgtgaagacgcaatagcagataagaaatatgttgtccttaaaaatgaaggcatcacttttatgtcattaatggttaacacttgctatgacattacagctgaaggagtacctttcataccgtatgcatgtgcaggtgtaggagcagaccttataaacgtatttaaggattttaatttaaaattctcataccaagggaaaataggtattagctatccaatcacaccagaagtttccgcttttattggaggatactaccacggagttataggaaataattttaacaaaatacctgtaataacacctgtagtattagaaggagctcctcaaaccacatctgcgctagtaactattgacactggatactttggcggagaagttggagtaaggttcaccttctagttttatttatttgttattatatataataaatagtgaaaaaaatttagcaattcataataatagggaaaatgtgaagttatttcaagttttcccttatgtattttatattagaagatattcttgccatgtatttctacaattgtatatggtttctaggaatagatgtttttcgtgcacgcataaaacgtattaaatttctcttacaaagactacttatgtattatagtaaaaactagcttataacttgtttttacattgtagttctactattgttaatttattttcactattttaggtataatatgaactgcaaaaaattttttataacaactgcattggcattgccaatgtctttcttacctggaatattactttctgaaccagtacaagatgacagtgtgagtggcaatttctatattagtggcaagtacatgccaagtgcttctcattttggagttttctctgccaaagaagaaaaaaatcctactgtcgcgttgtatggtttgaaacaagattggaacggtgttagtgcttcaagtcatgctgatgcggactttaataacaaaggttattcttttaaatacgaaaacaatccatttctaggttttgcaggagctattggttattcaatgggtggtccaagaatagagtttgaagtgtcctatgaaacatttgacgtgaaaaatcaaggtggtaattacaaaaatgatgctcacagatactgtgccttagatcgtaaagcaagcagcactaatgccacagctagtcactacgtgctactaaaaaatgaaggactacttgatatatcacttatgttgaatgcatgctatgacgtagtaagtgaaggaatacctttctctccttacatatgtgcaggtgttggtaccgatttaatatccatgtttgaagctataaaccctaaaatttcttatcaaggaaagttaggtttgagttactctataaacccagaagcttctgtctttgttggtggacattttcataaagttgcaggtaatgaattcagggacatttctactcttaaagcgtttgctacaccatcatctgcagctactccagacttagcaacagtaacactgagtgtgtgtcactttggagtagaacttggaggaagatttaacttctaattttattattgccacatgttaaaaataatctaaacttgttttcattattgctacaaataaataaaatagtggcaaaaaaatgtagcaataagaggggggggggggactaattactatctgccatatcccttactaccacttacactaaataatctgacaaatacaacagcttctggagaaataaacaatatttaaatttttcttacaaaaaccatttatatcttgtactaaaaactagcttataacttgtttttacattgtaggtttactactgttaatttgttttcactatttcaggtgtaatatgaactgcgaaaaattttttataacaactgcattaacattactaatgtccttcttacctggaatatcactttctgatccagtacaggatgacaacattagtggtaatttctacatcagtggaaagtatatgccaagcgcttcgcattttggagttttttctgccaaggaagaaagaaatacaacagttggagtatttggaatagagcaagattgggatagatgtgtaatatctagaaccactttaagcgatatattcaccgttccaaattattcatttaagtatgaaaataatctattttcaggatttgcaggagctattggctactcaatggatggcccaagaatagagcttgaagtatcttatgaagcattcgatgttaaaaatcaaggtaacaattataagaacgaagcacatagatattatgctctgtcccatcttctcggcacagagacacagatagatggtgcaggcagtgcgtctgtctttctaataaatgaaggactacttgataaatcatttatgctgaacgcatgttatgatgtaataagtgaaggcatacctttttctccttatatatgtgcaggtattggtattgatttagtatccatgtttgaagctataaatcctaaaatttcttatcaaggaaaattaggcttaagttaccctataagcccagaagcttctgtgtttattggtggacattttcataaggtgataggaaacgaatttagagatattcctactatgatacctagtgaatcagcgcttgcaggaaaaggaaactaccctgcaatagtaacactggacgtgttctactttggcatagaacttggaggaaggtttaacttccaactttgattattgccacaataaataaaaatagtggcaaaagaatgtagcaataagaggggggaggggggaactaaattattatttgccatatcccttactaccacttacaccaaataatctgacaaatacaacagttcaaacaaaggtaaacaattcttaaatttgtcttatgagaaccattgatatcttatattaaaaactagcttataacttgtctttacattgcagttctactattgttaatttattttcactattttaggtgtaatatgaattgcaaaaaattttttataacaactgcattagtatcactaatgtcctttctacctggaatatcattttctgatccagtgcaaggtgacaatattagtggtaatttctatgttagtggcaagtatatgccaagtgcttcgcattttggcatgttttctgccaaagaagaaaaaaatcctactgttgcattgtatggcttaaaacaagattgggaagggattagctcatcaagtcacaatgataatcatttcaataacaagggttattcatttaaatatgaaaataacccatttttagggtttgcaggagctattggttattcaatgggtggtccaagagtagagtttgaagtgtcctatgaaacatttgacgttaaaaatcagggtaataactataaaaatgatgctcacagatactgtgctttaggtcaacaagacaacagcggaatacctaaaactagtaaatacgtactgttaaaaagcgaaggattgcttgacatatcatttatgctaaatgcatgctatgatataataaacgagagcatacctttgtctccttacatatgtgcaggtgttggtactgatttaatatccatgtttgaagctacaaatcctaaaatttcttaccaagggaagttaggtctaagttactctataaacccagaagcttctgtatttattggtggacattttcataaggtgataggaaacgaatttagggacattcctactctgaaagcatttgttacgtcatcagctactccagatctagcaatagtaacactaagtgtatgtcattttggaatagaacttggaggaaggtttaacttctaattttgttattgccacatgttaaaaataatctaaacttgttttcattattgctacagtaaataaaaatagtggcaaaagaatgtagcaataagaaggggggggggggactaaattgctatttaccatatcccttattataccacttacactaaataacttgacaaatacaacagcttctggaaaaacaaacaatacttaaatttctcttacaaaaaccatttatatcttgtactaaaaactagcttataacttgtttttacattgtagttctactattgttaatttattttcactattttaggtgcaatatgaattgcaaaaaattttttataacaactacattagtatcgctaatgtccttcttacctggaatatcattttctgatgcagtacagaacgacaatgttggtggtaatttctatatcagtgggaaatatgtaccaagtgtttcacattttggcgtattctctgctaaacaggaaagaaatacaacaaccggagtatttggattaaagcaagattgggatggcagcacaatatctaaaaattctccagaaaatacatttaacgttccaaattattcatttaaatatgaaaataatccatttctaggttttgcaggagctgttggttatttaatgaatggtccaagaatagagttagaaatgtcctatgaaacatttgatgtgaaaaaccagggtaataactataagaacgatgctcacaaatattatgctttaacccataacagtgggggaaagctaagcaatgcaggtgataagtttgtttttctaaaaaatgaaggactacttgatatatcacttatgttgaatgcatgctatgatgtaataagtgaaggaatacctttctctccttacatatgtgcaggtgttggtactgatttaatatccatgtttgaagctataaaccctaaaatttcttatcaaggaaagttaggtttgagttactccataagcccagaagcttctgtttttgttggtggacattttcataaggtgatagggaatgaattcagagatattcctgctatgatacccagtacctcaactctcacaggtaatcactttactatagtaacactaagtgtatgccactttggagtggaacttggaggaaggtttaacttttaattttattattgccacatgttaaaaataatctaaacttgtttttattattgctgcaggtaaataaaaatagtggcaaaagaatgtagcaataagaggggggggggggggactagtttataagtgctgtttttctcacctttacacatgatactatacttaaccagtttttttgctattacttacctgacgtaatatattaaattttccttacaaaagttaccgatattttatacaaaaatttatattctgacttgcttttatatgacacttctactattgttaatttatttgtcactattaggttatatatgaattacaaaaaagttttcataacaagtgcattgatatcattaatatcttctctacctggagtatcattttccgacccagcaggtagtggtattaacggtaatttctacatcagtggaaaatacatgccaagtgcttcgcattttggagtattctctgctaaggaagaaagaaatacaacagttggagtgtttggactgaagcaaaattgggacggaagcgcaatatccaactcctccccaaacgatgtattcactgtctcaaattattcatttaaatatgaaaacaacccgtttttaggttttgcaggagctattggttactcaatggatggtccaagaatagagcttgaagtatcttatgaaacatttgatgtaaaaaatcaaggtaacaattataagaatgaagcacatagatattgtgctctatcccataactcagcagcagacatgagtagtgcaagtaataattttgtctttctaaaaaatgaaggattacttgacatatcatttatgctgaacgcatgctatgacgtagtaggcgaaggcatacctttttctccttatatatgcgcaggtatcggtactgatttagtatccatgtttgaagctacaaatcctaaaatttcttaccaaggaaagttaggtttaagctactctataagcccagaagcttctgtgtttattggtgggcactttcataaggtaatagggaacgaatttagagatattcctactataatacctactggatcaacacttgcaggaaaaggaaactaccctgcaatagtaatactggatgtatgccactttggaatagaacttggaggaaggtttgctttctaacctggcagtgtgtagtttctattttagtgtgatttctacaataaaaggtaagttgagttcattataggtagctagtaattatttttttcataaacctagtttttttacacacattgtaattattagttaaaagtaaacagagcttttacagtactttattagttttagcataaaaactacttagagtctttatgtagcaagatatagaacgcggtttattatgtaaaacacaagccaccagtctacagttacacaacagcataactgtagcagtacagaaataatgtaaggcatatacctacaccaaacaccaaaattagaagttccaattaaccaaaacaaactgtaatgtaaagtcttattatacaatataaggacaaaaaatttatgtttataaaatcctatagtgtaaatctcataccaacttcccaaccaaaataatcagtatctaaagtagcagatgctgaagtagttttaggcacattcgttaatgtggcaggatgataagctatttctactctttcatacctattacctataaccttatgataataacctccaccaaataacataacattaacactcacaggatagttaaccccaaatttcacttgataagaaaatttaggcaatgatattcccaaaaattttatgtaatctgctccaacaccagcacacatatatggtgctaaaggaatactaccatgagcaatatcataacaaaagttcacattaagagatttatcaataacaccatcattttctaacactataaacttattatcttgaacagtggactcacgagatagagcaaaaaacttatggctttctcctccttcaggataccactgtctttcgggttcaaaattttcataagcaccttcaaactctactctaaaatcattaacataatatccaataacaccaccaaacccagcaaaattgcttgcatatgtaggattatacgcttgtgtaaaacctgcatggtcactaatgctagatttatcaaggcctaaagcaaaaatactttttgtgagtccaggaagtgtttcttcagctgaaaaattactgaaattaggaacaccaactttatattgagtacctacataaaatccctttctcccttcaggaacgtttgcatcagaaaaagaattatcaggcaagaaagaaagcaatgtagccaatgcaacacctacaacaaattttttgtaattcatcttacatccattaataacaaggtaaactatggtaatttactatgacaaaccatgccaagtcaagtaattgtacacaattccacttattacataataaatgcataacagtaatacacaggaatgaaattttacctttctcaatagtcagctacatgtaagatatttcagctgttttggtaattctatacaaatacctttataccaatttctgcaccaaaatattccatatccagcttagctgctgttgaaatattaagaggattgggtaaggatacatattgcacaggaatattattatactcattaccaaccactctatgataatatacatcaaaaaataacaacatatcctgagacattaaataattgattccaagtttactgttaaaagaaggtttaaatctaattgagtcaaaaattttaataatatcttctccaatacccacacaagaaaaaggaacaatattagtatcaactgcaaaatcgtaacaaatatttagtatagttgaatagaattctacaccatcattttttaaaacaaaatagtcatacaatgtaggtggattggatctgactaaagcaatgtgcctataattattatctactaaatgatttctagtatctatcacatcaaatttcttataagatccttcaagttctactcttaaattcctaaatgaatacccaaatataaaagacaatccaaaaatattattgtcatattttggaacatattcttctgagaaattgaagttattaaaatctttcatagctttatcagcatctaataaaatatcactttttaagcctacaaccctatcagtttttacaccatttatcctatatgtttcacctatcgaaaaactactaaacagaggagcactcaatttataagaaatccctagaaaaacaggttttaacctgctgttcaaagaatctgatacatctaatgaacctgaaaaacaacaacaaggtaccaataataacatcaatattattactgaaatcctatatctcataagttaatttacccagtaacaataaataattattaattatatagtaaaaatattaataatataataaaggtaaatttacttatgcacatattttattagatacatttttaaagcattcatatacaattgctatacacaactcagatcataaaacagaaatcctatacacacaacaccattcaaaacataacaatcaaaatcatattataaatactaaagctgttttacaccattaaactttacaaaaactaatataactttactataaatactctgttctattaggtgagcgtcttgtaataaaactgatatacatatgtataagcgatatatgtaccagtagatgatattttagagtaatactgtaccccttcaatttgcaagaaaaccatagggataagatagaaaaaatattgtttttatacattaactagtatatataggttatacacgtgttatttaatgttaggtaaaacaatgaatgatttagatctttataatgaaacaaacatatcaacagagactgcagattacagtcaccttcctacttcacatttaatgaatgcactcaatcatgactgtgtttctaggtttgaagttaaattatctccaacatctgtggataatgaatactctgtcgaattcacatttgaacaatataaaaacaatgcagaacaagatctattgaaattaatagtaggagaatttggagttaattttgacccagaacatcataagttatctttaatcgatggtgatacttctgtaatactagaagaagacatgataaattcatgtttaagttgcataaaggtagtacaaaaagaccattctgcagaataatctacgtatttttatatataaaaattttaataaggaagggcctattttttattgactcacaaaaagtttactaattcaaatagggtcctttcacataattcatcgattacttaccctaaatacaacgcacatttcatgtactaatcagcaggttgaaaacaacgtgtgatcagatcacctgtacaatattaatttactatactacttaaattaaatttgtgacatatcaggattataaactattttatctcaattctcacccaaaatgtagcattattacatattcatatttaaaaatttaaatataagtatcttaagtaaactttgatatacattattcctgattcgaaagaaatagtttaggatctttggtaatttattttttttatcaaacaaaatatattgttttattatattaacaagatataataacactattaataaaatttaggtaagctataatggatatttttggcaatgaattcgatgttcacgttaacgcaaacggaacagagtacgcaggaaaaatgagtatagacagcaatggtgatttcgatgtcaatctcgacttacaagatggtgtgggaactttaggccatctctctggacacatatctcaaagtgacgatgctgctaattatattattgagtatatatttgaccaatgtataatttatccagaattacctgttttacattcatttaatggacaaatagtatctcctgctgaagaaggtagcattatttttgacaatggtgataacattcaaatttcattacatggcttacaagagcaaccagaagaagctatacctgctgcagaagtagaagaagctgtaccagcagaagcagctatacctgctgcggaagtaacagaaaatcaacaataatacttttcgtaggtatctttgttttttattaaaaattagttaataaataaatacttgtaaggtggatgcttggtttttgcaagtattcacattataagtagtaatgttgagatgtgttggaattgatttagtagactcttttatattcatgtagggattaacatctttatgagtttggctattttctaaaaaaattttcacatatatcgtctaatttataagtcttgtattagtcatcatagtactttatgcataatcaactacatgagattatcgtgttacatatgattcttgacaacatatgaaacccgaaaacatttacatagcctattgctaattttgttgtacttttatcttatttaatcatataattcacaacctaataaattaaatgttaatttaattatgctcagtattgcacacaagatctttggctcaacaaacagcaggataataaaatcatttcataaagtagttcaggatataaatgcaatagaacatgagattcaacttctttctaatgaagcattaaaacataaaaccatagaattcaaagaagaactcaaaaatggaaaaaccttagatgatattctagtaccagcctttgctgtggtaagagaagcctcaaaaagagtactaaatatgaggcactttgatgtacagcttataggtggaatagtcctacataaaggaatgatatccgaaatgaaaacgggcgaaggaaaaactttagtagcaacactagctgcatatttaaatgcattagaaggaaaaggagttcatatagtaacagtaaacgattatctagcaaaacgtgacgctgaatggatgggagaattatacagtgcattaggaataacagttggatgtatactcactgaaacaaatgacttagaaagaaaaaacgcttataactgtgacatattatattcaacaaacaataacctaggctttgactatttgcgtgataacatgaaattttctagagatgaaatggtgcaaaggggatttaattacgcaatagtcgatgaggtcgattcaatattaatagatgaagcaagaactccactaataatctccggacaagtcgaccaagatatcaaaatgtataaaaaaatagataatctgatatatgaattagcagaagaagattatgaactagaagaaaaaaacagaaatatctttttaactgaagccggaataacaaaaattgaaaatttattaatccagcataatcttatttcttccaatacatctttatacgacatagataacatcataatcatgcactacatcactcaagcattacgtgcgcataaaatgtttgctgtagataaagattatataattaaagacggcaacatagtaattatagatgaattcacaggccgtatgatggatggaagaagatattcagacggattgcatcaagcccttgaagcaaaagaaaaattaaatatcaatagtgaaaaccaaacactagcttctactacatttcaaaattacttcagaatgtacacaaaactctctggcatgacaggcactgcagaaactgagtcagaagaattcttaggaatatataacttacaagttgtacaaattccaacaaatatacctgttcaaagaatagacttaaatgacgatatatattgtacagaagaagaaaaattcaattccgtcataaaatttatttcagaatgtcataaaaaactacagcctgtactagtaggaacagtcagtatcgaaaaatcagagatgctatctaaactattaacaaaaaataaattaaaacactctgtattaaatgcacgttaccatgaacaagaagcgtatataatagcacaagccggcatacctggaacaatcacaattgctacaaacatggctggtcgaggtacagatatacagcttggaggaaatttaaaaatgctagcaaaaacagcacttgctaacattacagacaaagaagcaatagaaataaaatacaaacaactcacagaaaaagtaaacagagataaagaaatagcaatacaagctggagggttatgtgtaattggcacagaacgtcatgaaagcagaagaattgacaatcaattaagaggaagatctggtagacaaggagatccagggctatccaaatttttcttatcattagaagatgacttattaagaatatttggctcagacaaaataaaaggagttcttcaaaagctaggcatgaaaaaagatgaagctattcaacacacatggataagcagatctattgaaaaagcacaacacaaggttgagtcaagaaattacgatattagaaaatctctattaaagtttgataatgtaatcaatgaacaaagaaaagttgttttcgaccaaagaaataaaattttagatagtgattcctacgatatttcaatcatatatagagatctcaatagtgatatagtaaatagtataatacatgacaagtactacaatttagacgatgatacatataaagcattatcatctgaattcacaagaatatacaatatcaccttggattacagcactatcagtaatttcgaaagtaaagacaaagttttagaacatctaaacgaaactgttgatgaacattttgcacaaaaaatagaagaatttacattaaaagatcaaaaagcatgggaccatgtagtaaaaaaagtcatgataatgtcattagattacttatggagagatcaccttgctgcactagatagtttaaaatgtgggataaacttaagatccatagcacaaaaagacccattaaatgagtttaaagctgaagcattctctatgcttgagaatatgatgagcaagttttatgaactaataatacagagattatcccatttgaagtttgatatagagttaaatgatacacaaagaatagaatataatatccatcattccaaaatttcacgtaatgaaaagtgcccatgtggatcaggaaaaaaattcaaacattgtcatggtgcttaatctttagttgcttacatattgtatgataaacacaattgtttcataccgttggtaactgcaaaactttctatcaaaggaataaactatattacaaccctaaaagtttgtctatttattcagttttataaaaccatagaaaacacacattcgatatttttatagcagaaataaaatttcataccatagccacttaattaaaaatgcatccacaaagtataataacaacacaaacaacaccaaatttattatttgtattggacaaacagaactctttatccatggatacaattcctattattccttcttcttgtccagagtagtaaaaaagacgcaagatcattatatttcattctagtataccaagctataggaggtattcacagaacaaaattatgtatctaactaatatctcaactatagcttacattttgaaatttttcgtataaaaatttatttttctatagatgccattctctcttgatcaacataaacatacttatatgtttttccttcatcttgaaaaattttataatccttattaaaagaatccctaatcatattagcatctgtaccattgtgcagaagaatacttacaacaggttcatcattaacccctgctccttttgatggatctgtcaatagcaaattatgttcatcaactaataaacaagcatcaaatccacttaatatagaaatcagaaaagttttattaatcgatgtaacattttttatatctgtcgcaggatcatgatgttcaagagtaatttgtaaatcacatttaccacaatatacatcaccataaactccatttgtaccatgatttattatattaattacacccttatcccctgttacatcattagcaatatccccactagcataatactcatctccttgagcattgatgtgcaatttgccatgataaacatcaatattagaatgaccattttgttgtattaaaaagtcaacctgacaaaaatcataatctgtattcataataaagcccacattatattacttacagatcaatataccacaattataaaaaaattaatataaatatttattttacaataaagcattaatacatattaatactagaatacaattagtattttacttacatattccaatccttattatacttataacaatattgtactatcaattaataccgcttcaacataatcaatatactatgatattttttgtagtttgcttatattataactttcaattcaagttcaattttacgttgtaaaaaatcacttttaaattattaatattaatataaatattatgccataaatttattattagttaaatatacatacttaatttattccatattaatcaaatcatttgcattattttattgacgtagtatattaagttatctttattatgtgttcagtatgtctttaaatatttgtttaccagaccaatccttactaagacccagaattacagtttttggtgtaggtggtgctggtggtaatgctgtaaataacatgatacagtctaatctgcacggcgttaactttgtagtagctaacacagatgcacaagcattagaactttccttgtcagaaaagaaaattcagctaggtatcggattaacaaaaggactaggagcaggatcacttccagaagtgggtagaggtgctgcagaagagtcaataaatgagattattgaggaaatctcagatagcaatatgctgttcataactgctggaatgggtggaggaacaggaacaggcgctgctcctgtaattgccagagttgccaaggagaacaaaattttaaccataggagttgttacaaaacctttccacttcgaaggggcacatcgaatgaggacagcagaatttgggttagaagaattacaaaggtatgttgatactctcatagtaattcctaatcaaaatctattcaggattgctaatgaaaaaacaacatttgcagatgcattcaaacttgcagacactgtcttacatacaggtgttcgtggcatcactgacttaatggtaatgccagggctcattaatctagactttgctgatattcgagcaataatgagtgaaatgggcaaagcaatgatgggtacaggagaagctgaaggagaaaatagagctatagccgctgccgaagcagctatatccaatcctctattagacaacatttcaatgaaaggcgcaaaaggcatattaattaatatcactggcggattggatatgactctatttgaagttgatgcagctgcaaatcgtataagagaagaagtagatagtcacgctaacataatatttggatcaacgtttaataaagaaagtgaagggaaaattagagtatctgtcttagcaacaggaatagataatgaagaagtagtaatacaaaataagagtgcattaaaagataaagaagctcataatgataagttatctgaaacatcaagtaaacctttcaacccgctagacaacgaaattgcttattataaaccaagcaacccgggagaagatatgattcattccataaatcatacaaaaaaacaagatcacaatatagaaaaccaaaaatccaacaataaaattcccgaatcagcttataaaatgcaatttaataagaatgaatattgggatgaggaatcatttaatataccaacttttttaagaaaaaaataaggtataatgtcctactggcttttaaaaacagaaccccaagatttttcatgggatgatatggtgcgtgataatgttactgtatgggataatgtgttaaactatcaagctcaaaattatctaaaaacaatgaaatataatgatcttgcatttttttatcactctggaaaagaaaaaggaataataggaattgtatccatagataaagaattttatttgcccaatacaaataataaatttggtgttgttgaagttaaaacacatataaaactaaataagactgtctttttgaaagacataaaatcaaatccaacattaaaaactatgttaattctaaaacaaccacgtctttcagtttctcaagtaacagaacaagaatggaattgtattttacatttaggtgagactatcttatgattgaaatcaatatttactataggaagtggtataatataataaataagccaaaaagttttataaaaaaaattattaatacttctctaatagatttaaatatttatgaatacaaacctacaatttctgttgtgctagcaaacaatagactactacaaaaactaaattatgaatataggaaaaaaaataaaccaacaaacgtactatcattcccatacaataaattaaataagtattgttatttaggagaaatttttgtttcattagacactcttataaacgaatctactgatttaaatataccaatagaacatcatacatctcatatgctcattcatggactattacatatcttagactataaccatgaagaaccattagagcaatacattatggaatctattgaaattaagttactagataaactaggcataaaaaatccttatgttccacgtgaaacataagcactaaaatttgtatttatcatcaattcacaatcaaaattcgtattatattttcattaatagtacttaagaataaaaaattcagtgacaccattctgatcttatatataatttaaaaaaacatgtaaattatctgtatgagcaaagcttttgctatagtaaatcaaaaaggtggtgtaggaaaaacaacaactagtataaacttatcaacagcttttgctatagtaaacaaaaaaactttgcttatagatttagatccacaaggtaatagtagtactgggtttggaattacctatgaacaaagaataaatacagtatatgaagtattggtcaacaatttacctatatcatcaactattataaaaactgaaataccaaatttacatttactaccatcaaccgtagatttatctgcagcagaaatcgaattaacacaagtgcaacaaagagaatttattttaaaaaaatctctatccgaagtaaaaaattcatacgactatatttttatcgattgtccaccatctttaggtttactaacagtaaatgcattgatagcagcagactcaatcataattcctctacaatgcgagttttttgccttagaaggacttagtcatctaatgaaaaccatagaaatagtaaaaaaacacctaaatccacttctatcaatagaaggaattattttaactatgtatgacaaaagaaataagctaagtgaacaagtagaagaagatattagaaaatatttaaaagaatctgtatacaaaacagttattcctagaaatgtaagactatctgaagccccatctcatggaaaacctgctattatttatgattttaaatgtgcaggttctcaagcatatatatatctagcaaaggaaatactaagaaaacaaaaaaaatattaggtattcaa

SEQ ID NO: 39 - DNA, 534 bp, Ehrlichia canis; identical to SEQ ID NO: 36

SEQ ID NO: 40 - DNA, 534 bp, Artificial Sequence; identical to SEQ ID NO: 35
  Ehrlichia canis mutated sequence

SEQ ID NO: 41 - protein, 177 aa, Artificial Sequence; identical to SEQ ID NO: 37
  Ehrlichia canis mutated sequence

SEQ ID NO: 42 - DNA, 50 bp, Artificial Sequence
  mutated Ehrlichia chaffeensis
gggtaagtaacacatggtactacagctcgagaaaaatgtgactattaatt

SEQ ID NO: 43 - DNA, 50 bp, Artificial Sequence
  mutated Ehrlichia chaffeensis
caaggtagtcggcaaataactcgagtatatataatcatgtatcgattata

SEQ ID NO: 44 - DNA, 50 bp, Artificial Sequence
  mutated Ehrlichia chaffeensis
ataattacatagaattaatgcagcactcgagaaaaatgtgactattaatt

SEQ ID NO: 45 - DNA, 50 bp, Artificial Sequence
  mutated Ehrlichia chaffeensis
caaggtagtcggcaaataactcgagtattatgctttataaatgttctcag

SEQ ID NO: 46 - DNA, 50 bp, Artificial Sequence
  mutated Ehrlichia chaffeensis
ataattacatagaattaatgcagcatattatgctttataaatgttctcag

SEQ ID NO: 47 - DNA, 50 bp, Artificial Sequence
  mutated Ehrlichia chaffeensis
aagtacagcaacataaactagtagttattatgctttataaatgttctcag

SEQ ID NO: 48 - DNA, 50 bp, Artificial Sequence
  mutated Ehrlichia chaffeensis
cccattcattgtgtaccatgatgtcgagctctttttacactgataattaa

SEQ ID NO: 49 - DNA, 50 bp, Artificial Sequence
  mutated Ehrlichia chaffeensis
gttccatcagccgtttattgagctcatatatattagtacatagctaatat

SEQ ID NO: 50 - DNA, 50 bp, Artificial Sequence
  mutated Ehrlichia chaffeensis
tattaatgtatcttaattacgtcgtgagctctttttacactgataattaa

SEQ ID NO: 51 - DNA, 50 bp, Artificial Sequence
  mutated Ehrlichia chaffeensis
gttccatcagccgtttattgagctcataatacgaaatatttacaagagtc

SEQ ID NO: 52 - DNA, 50 bp, Artificial Sequence
  mutated Ehrlichia chaffeensis
tattaatgtatcttaattacgtcgtataatacgaaatatttacaagagtc

SEQ ID NO: 53 - DNA, 50 bp, Artificial Sequence
  mutated Ehrlichia chaffeensis
ttcatgtcgttgtatttgatcatcaataatacgaaatatttacaagagtc

SEQ ID NO: 54 - DNA, 4234 bp, Artificial Sequence
  mutated Ehrlichia canis
  misc_feature (1)..(1045): Ehrlichia canis
  misc_feature (1052)..(1418): Tuf-2 cassette
  misc_feature (1419)..(2207): Spectinomycin coding region
  misc_feature (2225)..(2452): Amtr promoter
  misc_feature (2453)..(3163): mCherry coding region
  misc_feature (3180)..(4234): Ehrlichia canis
tgattcgtagtatctttcgtaaagctcaataatgcattttgctgatattgtttctttttcattgataattatttttagttcaataatgtcgttattaaaagaaaattgttgtaaaagctgatttgcaggtgagcaatctacaataccttgtattttaaagattatgtatttgtttcctgaattttctaaagcacttttccatcctgataagtgaatatttttaatatactcgtttttattatgtagactaattcgtaagctttttatattatttaaggaaaaaaaagaattattataatccttaatttgtaattgtattgacatgggttttttctgctaagatagtgaaatttaataaggaatatataatatcgttattctgatgtatgttatacgtgtattctggtataattttatacttaagatcatttgtattagatttataatgtgctagtaagttaataattatagttagtattttatttagtgtatcggagttataacagtaaattttacataataattgtatttttgacatattattattaaatgcattgagtgtttttaaattacttgtatatatgtgtatatatggtagcgatactttattaggtataatatcgtatacattatttacaatgctcataagattattatttgatttcagtaattttataattgagttgagaattgttatttctgtcataaaactaactttaattcacgaaaaggggaatatatgttttttatgaaagttagattgttaatattttctgattctctatttttatatgatacggcaacatggtgtagtataccgtgtttaatttgtgctggtattgatgcattgtctgtataacctgcttcatatacaatttctatcttgttaccatggatttgcttattaaatgaaatatatgattgtattgtatcaacgtaataatatttttgatctatcaattcttctgttccatttgtgtgtgttatttttacataattaacttttattattggattaaatagaagttgtatttttccaggtatactcgagaaaaatgtgactattaattttgactttttttaattaggtattgacatattgtaatctttaatttagttaaatcaattctaatctaaatttttttggtatcattttttgtttttttgtgttaattaatacaaggatgttaggttagcgttagtgtttttaggaggagtggccgagcggtcaaaggcagcagactgtaaatctgcccactagcgtgtacgtaggttcaaatcctacctcctccacgggagattatgcgggtatagctcaatggtagagtcccagccttccaagctggctacgtgggttcgattcccactatccgctctttatttttgaaatggtttaatgatgttaaaggtatttgtttatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataactcgagatcgatggctcctcctagaacgatcgccgcatgctagcataaaacgcgcgcactaacaagtgcccagcgcgctgcctcaaaaaatctccggaagtttcccggatatttattgatgattttatttttaatctagcataccatttacagttttattattacaaccatacattaaataactgttgcattaacattatgtatgatttatcctaagttatctgagtaacatatgggatattataatggtcagcaagggagaggaagataatatggcgatcatcaaagagtttatgagatttaaggtgcacatggaaggaagcgttaatggtcatgagtttgaaatcgaaggcgaaggcgaaggaagaccgtatgaaggcacacagacggctaaacttaaggtcacaaaaggcggaccgcttccattcgcgtgggatattctttcaccgcaatttatgtatggttctaaagcctatgtgaaacatcctgcggatattcctgactaccttaaactgtctttcccggaaggatttaaatgggaacgcgtcatgaacttcgaagatggcggcgttgttacggtgacgcaggattcatcactgcaagatggagaatttatttataaagttaaactgcgcggcacaaactttccgtcagacggacctgtcatgcagaagaaaacgatgggctgggaagccagcagcgagagaatgtacccggaggacggagcacttaaaggcgaaatcaagcaacgcctgaagctgaaagatggaggccattatgatgccgaggtcaagacgacatacaaagctaagaaaccggtacaattacctggagcatacaacgtcaatatcaagctggatattacgtcacataatgaagactatacgattgtagagcaatatgaaagagcagagggaagacactctacaggtggaatggacgaattatacaaatagggattaaattcccgggtatccactacaggaaatttcccatgtttgtttcattaacgatttttctatataccattgtgcatattcagatgccatagtgataagattattaattaatgtatcatcctgattgttattaatacgtaagaaagattttacttctgataatgtgataggtagagatgttggtacggttttgcgtataatacacaacatagaacttgctagcatataactccattgttatattgatcacttttttttgttgttgaggttttattaaaaaactaagttttctagtatactgaaagaaattttgttaaatattttagcaatgatatctttttcatgttgatttaaactttgtaaactactaggatttaataattgttcaataagatatttattgagtttttgggaattgtgagaatatattttttttattaatgatattaactcttgttctagagaatgttgaaagttcattaaaaagttagatgtgatatcttccattttattttcaaattttatttggtattttgtcattatgtcatcaattgtataagagaattcatctaattttttttgttgaataaatgctttttctttattgtgaaagttttctgtcatataatattactcttgatgtttgatgtattatatattcttgatttagtatataggaagcagtttgttttatgtataacattaacacattctccagtgcatagtattattaacttttctttattctgttaaattgacgtgttttcatgataaaaggaagatagactagagaacattagccagtgtactgtatttaaatttgataatacatgtgtagaatttacgagtaatacttttcttaagcaatatcatcaggatttttatttagataatgttaaaattatttataagatgtatttgagaatattaatttcttgttagaattttattgaaatttgcttggcaagttttataatacgttacgtcctgcatttttatagataacttcataaaatgttgaccggagaggtggccgagaggctgaaggcgacggtttgctaaaccgtt

SEQ ID NO: 55 - DNA, 3588 bp, Artificial Sequence
  mutated Anaplasma phagocytophilum
  misc_feature (1)..(840): Anaplasma phagocytophilum
  misc_feature (841)..(1052): open reading frame of Anaplasma phagocytophilum
  misc_feature (1053)..(1586): Gentamicin coding region
  misc_feature (1597)..(2307): mCherry coding region
  misc_feature (2308)..(2535): Amtr promoter
  misc_feature (2536)..(2881): open reading frame of Anaplasma phagocytophilum
  misc_feature (2882)..(3588): Anaplasma phagocytophilum
tacggcgcttcggcgttgtcgttaggttgaggttggggttttgagcctttatttttgccttggacataggctaattctcactaccattagttagagttttcgctacaaagtccttaaaacctccatagcctgttcctgttcctgttcctgttcctgttcctgttcctgttcctgttcctgttcctgttcctgttccgtatgcttgaccgccacatataccgcgatccgcgcatcgtttcctgactcctctgttctttcccagtgctttccgaagctagtcggctgtccgttagcgtgtttcgtcacacaaacctgcttattgatcttaggggaagaaatctccaccgccttagcaaaatggacaatgtccttacagaaggttttggcacgagcagcagaaaaaagcttatcagtttgtatcagtaactacatcatatgtgcttcctgtaagcaaagcagctgaaatacaatgctatctgtctattgttgattctaggtgatatatggaaagaaaagaaaatctaccagtaacatatgattattcagaaaagatttttgagaccattctgagaagaaaagaagaagaatttcaaaattctgtagacgacatacttcgtaaattttctgagcagctgtataggtcgctagaaagagaattacctgaattaatcaaaaaattgcaagcagatctactgtcacgagaattttcgggaattataagtgaaaaacacgggaaaaatcttataggcgagaatacttctaatatgttcctcgatgacgtaattgtgcaaattgttcaaggagctttagaagatttatcttgatataggttttttgtaaatgatggaaaattctgtttttcaaattctaaggaagagttcttcaaaggaatttccggtttcattagaagatgctaagttatttttaggcatcaacaataataaggaagatgcgcttttacgtaatctcatctctatttctacagagtatgcacagtggtatatagaaagatcgttaatgcagcaaacatggcagttatcttatagcggtgattatgttgctgtacttggatcaatatcaaaatgcataacttcttctctaatacctaatttagtatataaagctactgcaggatcatctccataatcagcttgaacataaattacatatgcacctaaagcatttgcttcatgttttaataaatttattaaagctgttgctattccttgtcttctatgttcaccagaaactgctaaatcatatatataaatttctgatcttggttgttcaaatctaggtaatacataagctgctaaagctccaactactgcttcttgatcaaaagctgctaaagctataaaagtttttgatcttaataaattacccaaataatcactatctggttgatgttgagaatatgttgcaacatctccaaattctctaccaaataaatctaaagctgctctcatactttttacttgatcaggacctaatctacaagttctaataattcccatactactaccacctaatttagtttttggtctacttccttgttgtgtaacatcatttgatgatcttaacataatttaatccctatttgtataattcgtccattccacctgtagagtgtcttccctctgctctttcatattgctctacaatcgtatagtcttcattatgtgacgtaatatccagcttgatattgacgttgtatgctccaggtaattgtaccggtttcttagctttgtatgtcgtcttgacctcggcatcataatggcctccatctttcagcttcaggcgttgcttgatttcgcctttaagtgctccgtcctccgggtacattctctcgctgctggcttcccagcccatcgttttcttctgcatgacaggtccgtctgacggaaagtttgtgccgcgcagtttaactttataaataaattctccatcttgcagtgatgaatcctgcgtcaccgtaacaacgccgccatcttcgaagttcatgacgcgttcccatttaaatccttccgggaaagacagtttaaggtagtcaggaatatccgcaggatgtttcacataggctttagaaccatacataaattgcggtgaaagaatatcccacgcgaatggaagcggtccgccttttgtgaccttaagtttagccgtctgtgtgccttcatacggtcttccttcgccttcgccttcgatttcaaactcatgaccattaacgcttccttccatgtgcaccttaaatctcataaactctttgatgatcgccatattatcttcctctcccttgctgaccattataatatcccttatgttactcagataacttaggataaatcatacataatgttaatgcaacagttatttaatgtatggttgtaataataaaactgtaaatggtatgctagattaaaaataaaatcatcaataaatatccgggaaacttccggagattttttgaggcagcgcgctgggcacttgttagtgcgcgcgttttatgctagcatgcggcgatcgttctaggagggtagttccgaaaaaaatatacttgccgtttggcccgctgatttccgtaacatctgtaaatacaactagtgctggagatgaaaaagttgcaataaagagcaataattactgcattgatatgttgcgctcaagtattgaactttcatcgtgtttaaattcagtgcgtgtggaaatagtctatagtgcagggtatttggctcctgaaataattcctgcgcaagttagacatgggatattgcatcatactgcaatttcttacaaaaaccgcagtaatgtagacataaagcatatgacttttcttaaagagatgtatcttccgtttcgtgaattaaaactagttctatgacaggtatcgagaggttatacagcgctttagttgagtacttacgttctgatgtgattttaaaagatctactaagtgatatatatgagcaggccccaacaaatgcatctctgccatacgtatacttgcattttcgttatatagaagaaatctgtacttttgatagactggcatatcgggcaatgatcatgtgctgttccttgagtaatagtcttgaggaggttatgaacataacagagcaggttagatctgtatgtatggcatttttctctgataaggagaagtatgtattgtcctatatacgatacagaattgcacatttatcgcagaacgtttttcaatcaaacatagatttagaggtcttaataagtgatagtagtgagcttccaagagaatgaatcaggtgtttatttaccactgaaaaatgtaaagagtgtcaaaataacactatgtaataaaaatagttatataagaagtgtacgctcagatggatggatgaatgctttagagagatctggtgaaaaacatgtgaccattaagatcaatgctatagtagggcgttctcgttctgagattgttctacgtgaatttgcaatggagaatcgtattataagttgtgaaatcctgttttctaacgaaacgaaagaaaaacttaggactaaatgctttatagaactttacgaaaagcactgtgaagctggaagtttaga

What is claimed is:

1. An immunogenic composition comprising:
   a Rickettsiale bacteria having a targeted allelic exchange mutation therein, wherein said targeted allelic exchange mutation comprises a disrupted gene that has had the integrity thereof restored; and
   a component selected from the group consisting of a veterinary-acceptable carrier, a pharmaceutical-acceptable carrier, an adjuvant, a preservative, a buffer, an antibiotic, cell culture supernatant, an immunomodulatory agent, and any combination thereof.

2. The immunogenic composition of claim 1, wherein said Rickettsiale bacteria is selected from the group consisting of species of *Ehrlichia, Anaplasma, Neorickettsia, Rickettsia,* and *Orientia.*

3. The immunogenic composition of claim 2, wherein the *Ehrlichia* bacteria species is selected from the group consisting of *Ehrlichia chaffeensis, Ehrlichia ruminatium,* and *Ehrlichia canis.*

4. The immunogenic composition of claim 2, wherein the *Anaplasma* bacteria is selected from the group consisting of *Anaplasma phagocytophilum, Anaplasma platys,* and *Anaplasma marginale.*

5. The immunogenic composition of claim 1, wherein the targeted allelic mutation attenuates the bacteria and/or inactivates a gene.

6. The immunogenic composition of claim 5, wherein the gene functions as an aid to replication.

7. The immunogenic composition of claim 2, wherein the targeted allelic exchange mutation is in a location selected from the group consisting of:
   a) Ech_0379 or Ech_0660 in *Ehrlichia chaffeensis;*
   b) Ecaj_0381 in *Ehrlichia canis;*
   c) APH_0634 in *Anaplasma phagocytophilum*
   d) Erum_3930 in *E. ruminatium;*
   e) AMH_581 in *Anaplasma marginale;* or
   f) EMUR_02070 in *Ehrlichia muris* AS145.

8. The immunogenic composition of claim 1, wherein said component is an adjuvant selected from the group consisting of a saponin, a cyclic GMP-AMP, montanide gel, or any combination thereof.

9. The immunogenic composition of claim 1, further comprising an antigen from another disease causing organism.

10. The immunogenic composition of claim 1, wherein said bacteria includes a sequence with at least 70% sequence identity with SEQ ID NO. 35, 54, or 55.

11. An immunogenic composition comprising:
    a Rickettsiale or Chlamydiale bacteria having a targeted allelic exchange mutation therein and includes a sequence with at least 70% sequence identity with SEQ ID NO. 35, 54, or 55; and
    a component selected from the group consisting of a veterinary-acceptable carrier, a pharmaceutical-acceptable carrier, an adjuvant, a preservative, a buffer, an antibiotic, cell culture supernatant, an immunomodulatory agent, and any combination thereof.

12. A method of reducing the incidence of or severity of at least one clinical sign caused by a Rickettsiale bacteria comprising the step of:
    administering an immunogenic composition at least once to an animal in need thereof, wherein said immunogenic composition comprises a Rickettsiale bacteria having a targeted allelic exchange mutation therein, wherein said targeted allelic exchange mutation comprises a disrupted gene that has had the integrity thereof restored, and a component selected from the group consisting of a veterinary-acceptable carrier, a pharmaceutical-acceptable carrier, an adjuvant, a preservative, a buffer, a stabilizer, an antibiotic, cell culture supernatant, an immunomodulatory agent, and any combination thereof.

13. The method of claim 12, wherein said immunogenic composition is administered using an administration mode selected from the group consisting of intravenously, intramuscularly, intranasally, intradermally, intratracheally, intravaginally, intravenously, intravascularly, intraarterially, intraperitoneally, orally, intrathecally, by direct injection into any target tissue, or any combination thereof.

14. The method of claim 12, wherein said reduction in incidence is at least 10% and is in comparison to a group of animals that have not received an administration of the immunogenic composition.

15. The method of claim 12, wherein said reduction in severity is at least 10% in comparison to a group of animals that have not received an administration of the immunogenic composition.

16. The method of claim 12, wherein the Rickettsiale bacteria is selected from the group consisting of species of *Ehrlichia, Anaplasma, Neorickettsia, Rickettsia,* and *Orientia.*

17. The method of claim 16, wherein the *Ehrlichia* bacteria is selected from the group consisting of *Ehrlichia chaffeensis, Ehrlichia ruminatium,* and *Ehrlichia canis.*

18. The method of claim 16, wherein the Anaplasma bacteria is selected from the group consisting of *Anaplasma phagocytophium, Anaplasma platys,* and *Anaplasma marginale.*

19. The method of claim 12, wherein the targeted allelic exchange mutation inactivates a gene.

20. The method of claim 12, wherein the targeted allelic exchange mutation is in a location selected from the group consisting of:
    a) Ech_0379, or Ech_0660 in *Ehrlichia chaffeensis;*
    b) Ecaj_0381 in *Ehrilichia canis;*
    c). APH_0634 in *Anaplasma phagocytophilum;*
    d) Erum_3930 in *E. ruminatium;*
    e) AMH_581 in *Anaplasma marginale;* or
    f) EMUR_02070 in *Ehrlichia muris* AS145.

21. The method of claim 12, wherein said bacteria includes a sequence with at least 70% sequence identity with SEQ ID NO. 35, 54, or 55.

22. The method of claim 12, wherein said animal is selected from the group consisting of pigs, cattle, goats, horses, dogs, deer, coyote, cats, and poultry.

23. The method of claim 12, wherein said animal is between 3 weeks and 6 months of age when receiving said administration.

* * * * *